United States Patent 11,920,148 (COMPOSITIONS AND METHODS FOR GENE EDITING) - sequence listing, part 2

SEQ ID NO: 7318 - DNA, 20 bp, Artificial Sequence
  Description of Artificial Sequence: Synthetic oligonucleotide
  Target: ANGPTL3; (-) strand; PAM type: NRG; PAM sequence: GAG
atcctcttgaatagctgttt

SEQ ID NO: 7319 - DNA, 20 bp, Artificial Sequence
  Description of Artificial Sequence: Synthetic oligonucleotide
  Target: ANGPTL3; (-) strand; PAM type: NRG; PAM sequence: TAG
gttttttgaatcctcttgaa

SEQ ID NO: 7320 - DNA, 20 bp, Artificial Sequence
  Description of Artificial Sequence: Synthetic oligonucleotide
  Target: ANGPTL3; (-) strand; PAM type: NRG; PAM sequence: GAG
ttttgtttaccagtttctct

SEQ ID NO: 7321 - DNA, 20 bp, Artificial Sequence
  Description of Artificial Sequence: Synthetic oligonucleotide
  Target: ANGPTL3; (-) strand; PAM type: NRG; PAM sequence: CAG
ttgaaaatgattttgtttac

SEQ ID NO: 7322 - DNA, 20 bp, Artificial Sequence
  Description of Artificial Sequence: Synthetic oligonucleotide
  Target: ANGPTL3; (-) strand; PAM type: NRG; PAM sequence: TGG
tatgtttgtttagtggaaat

SEQ ID NO: 7323 - DNA, 20 bp, Artificial Sequence
  Description of Artificial Sequence: Synthetic oligonucleotide
  Target: ANGPTL3; (-) strand; PAM type: NRG; PAM sequence: TGG
ctaacattatgtttgtttag

SEQ ID NO: 7324 - DNA, 20 bp, Artificial Sequence
  Description of Artificial Sequence: Synthetic oligonucleotide
  Target: ANGPTL3; (-) strand; PAM type: NRG; PAM sequence: TAG
ctactaacattatgtttgtt

SEQ ID NO: 7325 - DNA, 20 bp, Artificial Sequence
  Description of Artificial Sequence: Synthetic oligonucleotide
  Target: ANGPTL3; (-) strand; PAM type: NRG; PAM sequence: CAG
gttgataaaaaaccttttag

SEQ ID NO: 7326 - DNA, 20 bp, Artificial Sequence
  Description of Artificial Sequence: Synthetic oligonucleotide
  Target: ANGPTL3; (-) strand; PAM type: NRG; PAM sequence: TAG
gtagttgataaaaaaccttt

SEQ ID NO: 7327 - DNA, 20 bp, Artificial Sequence
  Description of Artificial Sequence: Synthetic oligonucleotide
  Target: ANGPTL3; (-) strand; PAM type: NRG; PAM sequence: TAG
gaaagtatggaaaccaaaag

SEQ ID NO: 7328 - DNA, 20 bp, Artificial Sequence
  Description of Artificial Sequence: Synthetic oligonucleotide
  Target: ANGPTL3; (-) strand; PAM type: NRG; PAM sequence: AAG
aaggaaagtatggaaaccaa

SEQ ID NO: 7329 - DNA, 20 bp, Artificial Sequence
  Description of Artificial Sequence: Synthetic oligonucleotide
  Target: ANGPTL3; (-) strand; PAM type: NRG; PAM sequence: TGG
acatcataagaaggaaagta

SEQ ID NO: 7330 - DNA, 20 bp, Artificial Sequence
  Description of Artificial Sequence: Synthetic oligonucleotide
  Target: ANGPTL3; (-) strand; PAM type: NRG; PAM sequence: AAG
taataacatcataagaagga

SEQ ID NO: 7331 - DNA, 20 bp, Artificial Sequence
  Description of Artificial Sequence: Synthetic oligonucleotide
  Target: ANGPTL3; (-) strand; PAM type: NRG; PAM sequence: AGG
agaataataacatcataaga

SEQ ID NO: 7332 - DNA, 20 bp, Artificial Sequence
  Description of Artificial Sequence: Synthetic oligonucleotide
  Target: ANGPTL3; (-) strand; PAM type: NRG; PAM sequence: AAG
tagaataataacatcataag

SEQ ID NO: 7333 - DNA, 20 bp, Artificial Sequence
  Description of Artificial Sequence: Synthetic oligonucleotide
  Target: ANGPTL3; (-) strand; PAM type: NRG; PAM sequence: AAG
atttagaataataacatcat

SEQ ID NO: 7334 - DNA, 20 bp, Artificial Sequence
  Description of Artificial Sequence: Synthetic oligonucleotide
  Target: ANGPTL3; (-) strand; PAM type: NRG; PAM sequence: TAG
agatataattgaaaagaatt

SEQ ID NO: 7335 - DNA, 20 bp, Artificial Sequence
  Description of Artificial Sequence: Synthetic oligonucleotide
  Target: ANGPTL3; (-) strand; PAM type: NRG; PAM sequence: AAG
tagtaaaagatataattgaa

SEQ ID NO: 7336 - DNA, 20 bp, Artificial Sequence
  Description of Artificial Sequence: Synthetic oligonucleotide
  Target: ANGPTL3; (-) strand; PAM type: NRG; PAM sequence: AAG
ggttcatttaatcatagtaa

SEQ ID NO: 7337 - DNA, 20 bp, Artificial Sequence
  Description of Artificial Sequence: Synthetic oligonucleotide
  Target: ANGPTL3; (-) strand; PAM type: NRG; PAM sequence: TAG
ggagcaggttcatttaatca

SEQ ID NO: 7338 - DNA, 20 bp, Artificial Sequence
  Description of Artificial Sequence: Synthetic oligonucleotide
  Target: ANGPTL3; (-) strand; PAM type: NRG; PAM sequence: AGG
aacattttgctttggggagc

SEQ ID NO: 7339 - DNA, 20 bp, Artificial Sequence
  Description of Artificial Sequence: Synthetic oligonucleotide
  Target: ANGPTL3; (-) strand; PAM type: NRG; PAM sequence: CAG
taacattttgctttggggag

SEQ ID NO: 7340 - DNA, 20 bp, Artificial Sequence
  Description of Artificial Sequence: Synthetic oligonucleotide
  Target: ANGPTL3; (-) strand; PAM type: NRG; PAM sequence: GAG
tagtaacattttgctttggg

SEQ ID NO: 7341 - DNA, 20 bp, Artificial Sequence
  Description of Artificial Sequence: Synthetic oligonucleotide
  Target: ANGPTL3; (-) strand; PAM type: NRG; PAM sequence: GGG
tatagtaacattttgctttg

SEQ ID NO: 7342 - DNA, 20 bp, Artificial Sequence
  Description of Artificial Sequence: Synthetic oligonucleotide
  Target: ANGPTL3; (-) strand; PAM type: NRG; PAM sequence: GGG
ctatagtaacattttgcttt

SEQ ID NO: 7343 - DNA, 20 bp, Artificial Sequence
  Description of Artificial Sequence: Synthetic oligonucleotide
  Target: ANGPTL3; (-) strand; PAM type: NRG; PAM sequence: TGG
actatagtaacattttgctt

SEQ ID NO: 7344 - DNA, 20 bp, Artificial Sequence
  Description of Artificial Sequence: Synthetic oligonucleotide
  Target: ANGPTL3; (-) strand; PAM type: NRG; PAM sequence: TAG
agacacaatgtatattacta

SEQ ID NO: 7345 - DNA, 20 bp, Artificial Sequence
  Description of Artificial Sequence: Synthetic oligonucleotide
  Target: ANGPTL3; (-) strand; PAM type: NRG; PAM sequence: TAG
tcttcacacatttttatttt

SEQ ID NO: 7346 - DNA, 20 bp, Artificial Sequence
  Description of Artificial Sequence: Synthetic oligonucleotide
  Target: ANGPTL3; (-) strand; PAM type: NRG; PAM sequence: TGG
aactcagaaattcattgttt

SEQ ID NO: 7347 - DNA, 20 bp, Artificial Sequence
  Description of Artificial Sequence: Synthetic oligonucleotide
  Target: ANGPTL3; (-) strand; PAM type: NRG; PAM sequence: CAG
atctaactcttcttccaact

SEQ ID NO: 7348 - DNA, 20 bp, Artificial Sequence
  Description of Artificial Sequence: Synthetic oligonucleotide
  Target: ANGPTL3; (-) strand; PAM type: NRG; PAM sequence: AAG
tttttaatttaaatatgaga

SEQ ID NO: 7349 - DNA, 20 bp, Artificial Sequence
  Description of Artificial Sequence: Synthetic oligonucleotide
  Target: ANGPTL3; (-) strand; PAM type: NRG; PAM sequence: GAG
tgtttttttaatttaaatat

SEQ ID NO: 7350 - DNA, 20 bp, Artificial Sequence
  Description of Artificial Sequence: Synthetic oligonucleotide
  Target: ANGPTL3; (-) strand; PAM type: NRG; PAM sequence: GAG
taaagttacttaaattttta

SEQ ID NO: 7351 - DNA, 20 bp, Artificial Sequence
  Description of Artificial Sequence: Synthetic oligonucleotide
  Target: ANGPTL3; (-) strand; PAM type: NRG; PAM sequence: TAG
cttaaagttacttaaatttt

SEQ ID NO: 7352 - DNA, 20 bp, Artificial Sequence
  Description of Artificial Sequence: Synthetic oligonucleotide
  Target: ANGPTL3; (-) strand; PAM type: NRG; PAM sequence: AAG
taagtaactatgtgatctta

SEQ ID NO: 7353 - DNA, 20 bp, Artificial Sequence
  Description of Artificial Sequence: Synthetic oligonucleotide
  Target: ANGPTL3; (-) strand; PAM type: NRG; PAM sequence: AAG
gggtattactcttttctact

SEQ ID NO: 7354 - DNA, 20 bp, Artificial Sequence
  Description of Artificial Sequence: Synthetic oligonucleotide
  Target: ANGPTL3; (-) strand; PAM type: NRG; PAM sequence: GGG
tattgtaaagtttgcttgct

SEQ ID NO: 7355 - DNA, 20 bp, Artificial Sequence
  Description of Artificial Sequence: Synthetic oligonucleotide
  Target: ANGPTL3; (-) strand; PAM type: NRG; PAM sequence: TGG
ctattgtaaagtttgcttgc

SEQ ID NO: 7356 - DNA, 20 bp, Artificial Sequence
  Description of Artificial Sequence: Synthetic oligonucleotide
  Target: ANGPTL3; (-) strand; PAM type: NRG; PAM sequence: AAG
atttaaaaggatctattgta

SEQ ID NO: 7357 - DNA, 20 bp, Artificial Sequence
  Description of Artificial Sequence: Synthetic oligonucleotide
  Target: ANGPTL3; (-) strand; PAM type: NRG; PAM sequence: AGG
ttcctaggaccttatttaaa

SEQ ID NO: 7358 - DNA, 20 bp, Artificial Sequence
  Description of Artificial Sequence: Synthetic oligonucleotide
  Target: ANGPTL3; (-) strand; PAM type: NRG; PAM sequence: AAG
tttcctaggaccttatttaa

SEQ ID NO: 7359 - DNA, 20 bp, Artificial Sequence
  Description of Artificial Sequence: Synthetic oligonucleotide
  Target: ANGPTL3; (-) strand; PAM type: NRG; PAM sequence: AGG
tggcatgaatgatatttcct

SEQ ID NO: 7360 - DNA, 20 bp, Artificial Sequence
  Description of Artificial Sequence: Synthetic oligonucleotide
  Target: ANGPTL3; (-) strand; PAM type: NRG; PAM sequence: TAG
ctggcatgaatgatatttcc

SEQ ID NO: 7361 - DNA, 20 bp, Artificial Sequence
  Description of Artificial Sequence: Synthetic oligonucleotide
  Target: ANGPTL3; (-) strand; PAM type: NRG; PAM sequence: TGG
tagtgttagttttttgatgc

SEQ ID NO: 7362 - DNA, 20 bp, Artificial Sequence
  Description of Artificial Sequence: Synthetic oligonucleotide
  Target: ANGPTL3; (-) strand; PAM type: NRG; PAM sequence: TAG
atatcttgcattattagtgt

SEQ ID NO: 7363 - DNA, 20 bp, Artificial Sequence
  Description of Artificial Sequence: Synthetic oligonucleotide
  Target: ANGPTL3; (-) strand; PAM type: NRG; PAM sequence: TAG
tatataatatcttgcattat

SEQ ID NO: 7364 - DNA, 20 bp, Artificial Sequence
  Description of Artificial Sequence: Synthetic oligonucleotide
  Target: ANGPTL3; (-) strand; PAM type: NRG; PAM sequence: CAG
ctcattgacagtaagaaaag

SEQ ID NO: 7365 - DNA, 20 bp, Artificial Sequence
  Description of Artificial Sequence: Synthetic oligonucleotide
  Target: ANGPTL3; (-) strand; PAM type: NRG; PAM sequence: AAG
tttctcattgacagtaagaa

SEQ ID NO: 7366 - DNA, 20 bp, Artificial Sequence
  Description of Artificial Sequence: Synthetic oligonucleotide
  Target: ANGPTL3; (-) strand; PAM type: NRG; PAM sequence: AAG
tagtttttctcattgacagt

SEQ ID NO: 7367 - DNA, 20 bp, Artificial Sequence
  Description of Artificial Sequence: Synthetic oligonucleotide
  Target: ANGPTL3; (-) strand; PAM type: NRG; PAM sequence: CAG
atgatagtttttctcattga

SEQ ID NO: 7368 - DNA, 20 bp, Artificial Sequence
  Description of Artificial Sequence: Synthetic oligonucleotide
  Target: ANGPTL3; (-) strand; PAM type: NRG; PAM sequence: TAG
gtttgcaatttattgaatga

SEQ ID NO: 7369 - DNA, 20 bp, Artificial Sequence
  Description of Artificial Sequence: Synthetic oligonucleotide
  Target: ANGPTL3; (-) strand; PAM type: NRG; PAM sequence: GGG
tatttttatttaagtgtgtt

SEQ ID NO: 7370 - DNA, 20 bp, Artificial Sequence
  Description of Artificial Sequence: Synthetic oligonucleotide
  Target: ANGPTL3; (-) strand; PAM type: NRG; PAM sequence: TGG
ttatttttatttaagtgtgt

SEQ ID NO: 7371 - DNA, 20 bp, Artificial Sequence
  Description of Artificial Sequence: Synthetic oligonucleotide
  Target: ANGPTL3; (-) strand; PAM type: NRG; PAM sequence: AAG
gtaacattttatttttattt

SEQ ID NO: 7372 - DNA, 20 bp, Artificial Sequence
  Description of Artificial Sequence: Synthetic oligonucleotide
  Target: ANGPTL3; (-) strand; PAM type: NRG; PAM sequence: CAG
gtagtttatcgttagtttag

SEQ ID NO: 7373 - DNA, 20 bp, Artificial Sequence
  Description of Artificial Sequence: Synthetic oligonucleotide
  Target: ANGPTL3; (-) strand; PAM type: NRG; PAM sequence: TAG
tcagtagtttatcgttagtt

SEQ ID NO: 7374 - DNA, 20 bp, Artificial Sequence
  Description of Artificial Sequence: Synthetic oligonucleotide
  Target: ANGPTL3; (-) strand; PAM type: NRG; PAM sequence: TAG
tatattcagtagtttatcgt

SEQ ID NO: 7375 - DNA, 20 bp, Artificial Sequence
  Description of Artificial Sequence: Synthetic oligonucleotide
  Target: ANGPTL3; (-) strand; PAM type: NRG; PAM sequence: TAG
cttactttctatatattcag

SEQ ID NO: 7376 - DNA, 20 bp, Artificial Sequence
  Description of Artificial Sequence: Synthetic oligonucleotide
  Target: ANGPTL3; (-) strand; PAM type: NRG; PAM sequence: CAG
ttgcttactttctatatatt

SEQ ID NO: 7377 - DNA, 20 bp, Artificial Sequence
  Description of Artificial Sequence: Synthetic oligonucleotide
  Target: ANGPTL3; (-) strand; PAM type: NRG; PAM sequence: AAG
gtagatgttggcaggttggc

SEQ ID NO: 7378 - DNA, 20 bp, Artificial Sequence
  Description of Artificial Sequence: Synthetic oligonucleotide
  Target: ANGPTL3; (-) strand; PAM type: NRG; PAM sequence: TGG
atctgtagatgttggcaggt

SEQ ID NO: 7379 - DNA, 20 bp, Artificial Sequence
  Description of Artificial Sequence: Synthetic oligonucleotide
  Target: ANGPTL3; (-) strand; PAM type: NRG; PAM sequence: AGG
acatatctgtagatgttggc

SEQ ID NO: 7380 - DNA, 20 bp, Artificial Sequence
  Description of Artificial Sequence: Synthetic oligonucleotide
  Target: ANGPTL3; (-) strand; PAM type: NRG; PAM sequence: CAG
aacatatctgtagatgttgg

SEQ ID NO: 7381 - DNA, 20 bp, Artificial Sequence
  Description of Artificial Sequence: Synthetic oligonucleotide
  Target: ANGPTL3; (-) strand; PAM type: NRG; PAM sequence: TGG
gtaaacatatctgtagatgt

SEQ ID NO: 7382 - DNA, 20 bp, Artificial Sequence
  Description of Artificial Sequence: Synthetic oligonucleotide
  Target: ANGPTL3; (-) strand; PAM type: NRG; PAM sequence: TAG
ttgacctgtaaacatatctg

SEQ ID NO: 7383 - DNA, 20 bp, Artificial Sequence
  Description of Artificial Sequence: Synthetic oligonucleotide
  Target: ANGPTL3; (-) strand; PAM type: NRG; PAM sequence: AGG
cataatacataatttgaacc

SEQ ID NO: 7384 - DNA, 20 bp, Artificial Sequence
  Description of Artificial Sequence: Synthetic oligonucleotide
  Target: ANGPTL3; (-) strand; PAM type: NRG; PAM sequence: CAG
acataatacataatttgaac

SEQ ID NO: 7385 - DNA, 20 bp, Artificial Sequence
  Description of Artificial Sequence: Synthetic oligonucleotide
  Target: ANGPTL3; (-) strand; PAM type: NRG; PAM sequence: AAG
tgatcttcagacctgtgata

SEQ ID NO: 7386 - DNA, 20 bp, Artificial Sequence
  Description of Artificial Sequence: Synthetic oligonucleotide
  Target: ANGPTL3; (-) strand; PAM type: NRG; PAM sequence: CAG
ttttaggtcttactgatctt

SEQ ID NO: 7387 - DNA, 20 bp, Artificial Sequence
  Description of Artificial Sequence: Synthetic oligonucleotide
  Target: ANGPTL3; (-) strand; PAM type: NRG; PAM sequence: AGG
gtttaataattttcagtttt

SEQ ID NO: 7388 - DNA, 20 bp, Artificial Sequence
  Description of Artificial Sequence: Synthetic oligonucleotide
  Target: ANGPTL3; (-) strand; PAM type: NRG; PAM sequence: TAG
agtttaataattttcagttt

SEQ ID NO: 7389 - DNA, 20 bp, Artificial Sequence
  Description of Artificial Sequence: Synthetic oligonucleotide
  Target: ANGPTL3; (-) strand; PAM type: NRG; PAM sequence: CAG
attttaagtttaataatttt

SEQ ID NO: 7390 - DNA, 20 bp, Artificial Sequence
  Description of Artificial Sequence: Synthetic oligonucleotide
  Target: ANGPTL3; (-) strand; PAM type: NRG; PAM sequence: AAG
tgatattctgttcagatttt

SEQ ID NO: 7391 - DNA, 20 bp, Artificial Sequence
  Description of Artificial Sequence: Synthetic oligonucleotide
  Target: ANGPTL3; (-) strand; PAM type: NRG; PAM sequence: CAG
aatatatttgatattctgtt

SEQ ID NO: 7392 - DNA, 20 bp, Artificial Sequence
  Description of Artificial Sequence: Synthetic oligonucleotide
  Target: ANGPTL3; (-) strand; PAM type: NRG; PAM sequence: TAG
aaagtagagactgctttgct

SEQ ID NO: 7393 - DNA, 20 bp, Artificial Sequence
  Description of Artificial Sequence: Synthetic oligonucleotide
  Target: ANGPTL3; (-) strand; PAM type: NRG; PAM sequence: GAG
acagagcaaggccaaaagta

SEQ ID NO: 7394 - DNA, 20 bp, Artificial Sequence
  Description of Artificial Sequence: Synthetic oligonucleotide
  Target: ANGPTL3; (-) strand; PAM type: NRG; PAM sequence: TAG
aaacagagcaaggccaaaag

SEQ ID NO: 7395 - DNA, 20 bp, Artificial Sequence
  Description of Artificial Sequence: Synthetic oligonucleotide
  Target: ANGPTL3; (-) strand; PAM type: NRG; PAM sequence: AAG
ggaaaacagagcaaggccaa

SEQ ID NO: 7396 - DNA, 20 bp, Artificial Sequence
  Description of Artificial Sequence: Synthetic oligonucleotide
  Target: ANGPTL3; (-) strand; PAM type: NRG; PAM sequence: AGG
attggtcggaaaacagagca

SEQ ID NO: 7397 - DNA, 20 bp, Artificial Sequence
  Description of Artificial Sequence: Synthetic oligonucleotide
  Target: ANGPTL3; (-) strand; PAM type: NRG; PAM sequence: AAG
cattggtcggaaaacagagc

SEQ ID NO: 7398 - DNA, 20 bp, Artificial Sequence
  Description of Artificial Sequence: Synthetic oligonucleotide
  Target: ANGPTL3; (-) strand; PAM type: NRG; PAM sequence: GAG
cagacattggtcggaaaaca

SEQ ID NO: 7399 - DNA, 20 bp, Artificial Sequence
  Description of Artificial Sequence: Synthetic oligonucleotide
  Target: ANGPTL3; (-) strand; PAM type: NRG; PAM sequence: CAG
agcagacattggtcggaaaa

SEQ ID NO: 7400 - DNA, 20 bp, Artificial Sequence
  Description of Artificial Sequence: Synthetic oligonucleotide
  Target: ANGPTL3; (-) strand; PAM type: NRG; PAM sequence: CGG
gcaaaaaagcagacattggt

SEQ ID NO: 7401 - DNA, 20 bp, Artificial Sequence
  Description of Artificial Sequence: Synthetic oligonucleotide
  Target: ANGPTL3; (-) strand; PAM type: NRG; PAM sequence: TGG
caaggcaaaaaagcagacat

SEQ ID NO: 7402 - DNA, 20 bp, Artificial Sequence
  Description of Artificial Sequence: Synthetic oligonucleotide
  Target: ANGPTL3; (-) strand; PAM type: NRG; PAM sequence: CAG
aataaagcaaggcaaaaaag

SEQ ID NO: 7403 - DNA, 20 bp, Artificial Sequence
  Description of Artificial Sequence: Synthetic oligonucleotide
  Target: ANGPTL3; (-) strand; PAM type: NRG; PAM sequence: AAG
aaaaataaagcaaggcaaaa

SEQ ID NO: 7404 - DNA, 20 bp, Artificial Sequence
  Description of Artificial Sequence: Synthetic oligonucleotide
  Target: ANGPTL3; (-) strand; PAM type: NRG; PAM sequence: AGG
taagataaaaaaataaagca

SEQ ID NO: 7405 - DNA, 20 bp, Artificial Sequence
  Description of Artificial Sequence: Synthetic oligonucleotide
  Target: ANGPTL3; (-) strand; PAM type: NRG; PAM sequence: AAG
ataagataaaaaaataaagc

SEQ ID NO: 7406 - DNA, 20 bp, Artificial Sequence
  Description of Artificial Sequence: Synthetic oligonucleotide
  Target: ANGPTL3; (-) strand; PAM type: NRG; PAM sequence: AAG
tttaataagataaaaaaata

SEQ ID NO: 7407 - DNA, 20 bp, Artificial Sequence
  Description of Artificial Sequence: Synthetic oligonucleotide
  Target: ANGPTL3; (-) strand; PAM type: NRG; PAM sequence: AAG
aatcagggacattatttaat

SEQ ID NO: 7408 - DNA, 20 bp, Artificial Sequence
  Description of Artificial Sequence: Synthetic oligonucleotide
  Target: ANGPTL3; (-) strand; PAM type: NRG; PAM sequence: GGG
gttctcaaaatatttaatca

SEQ ID NO: 7409 - DNA, 20 bp, Artificial Sequence
  Description of Artificial Sequence: Synthetic oligonucleotide
  Target: ANGPTL3; (-) strand; PAM type: NRG; PAM sequence: AGG
tgttctcaaaatatttaatc

SEQ ID NO: 7410 - DNA, 20 bp, Artificial Sequence
  Description of Artificial Sequence: Synthetic oligonucleotide
  Target: ANGPTL3; (-) strand; PAM type: NRG; PAM sequence: CAG
ctgttctcaaaatatttaat

SEQ ID NO: 7411 - DNA, 20 bp, Artificial Sequence
  Description of Artificial Sequence: Synthetic oligonucleotide
  Target: ANGPTL3; (-) strand; PAM type: NRG; PAM sequence: CAG
acagtgttattcagattgta

SEQ ID NO: 7412 - DNA, 20 bp, Artificial Sequence
  Description of Artificial Sequence: Synthetic oligonucleotide
  Target: ANGPTL3; (-) strand; PAM type: NRG; PAM sequence: CAG
tttagataaacagtgttatt

SEQ ID NO: 7413 - DNA, 20 bp, Artificial Sequence
  Description of Artificial Sequence: Synthetic oligonucleotide
  Target: ANGPTL3; (-) strand; PAM type: NRG; PAM sequence: CAG
gtgtttgatatttagataaa

SEQ ID NO: 7414 - DNA, 20 bp, Artificial Sequence
  Description of Artificial Sequence: Synthetic oligonucleotide
  Target: ANGPTL3; (-) strand; PAM type: NRG; PAM sequence: TAG
ttataacggtgtttgatatt

SEQ ID NO: 7415 - DNA, 20 bp, Artificial Sequence
  Description of Artificial Sequence: Synthetic oligonucleotide
  Target: ANGPTL3; (-) strand; PAM type: NRG; PAM sequence: CGG
ttcagttcataatgttataa

SEQ ID NO: 7416 - DNA, 20 bp, Artificial Sequence
  Description of Artificial Sequence: Synthetic oligonucleotide
  Target: ANGPTL3; (-) strand; PAM type: NRG; PAM sequence: CAG
cagaagtacagtttgtcttt

SEQ ID NO: 7417 - DNA, 20 bp, Artificial Sequence
  Description of Artificial Sequence: Synthetic oligonucleotide
  Target: ANGPTL3; (-) strand; PAM type: NRG; PAM sequence: CAG
gagtaaggatgtcagaagta

SEQ ID NO: 7418 - DNA, 20 bp, Artificial Sequence
  Description of Artificial Sequence: Synthetic oligonucleotide
  Target: ANGPTL3; (-) strand; PAM type: NRG; PAM sequence: AAG
aatctgagtaaggatgtcag

SEQ ID NO: 7419 - DNA, 20 bp, Artificial Sequence
  Description of Artificial Sequence: Synthetic oligonucleotide
  Target: ANGPTL3; (-) strand; PAM type: NRG; PAM sequence: CAG
ggaaatctgagtaaggatgt

SEQ ID NO: 7420 - DNA, 20 bp, Artificial Sequence
  Description of Artificial Sequence: Synthetic oligonucleotide
  Target: ANGPTL3; (-) strand; PAM type: NRG; PAM sequence: AGG
aattaggggaaatctgagta

SEQ ID NO: 7421 - DNA, 20 bp, Artificial Sequence
  Description of Artificial Sequence: Synthetic oligonucleotide
  Target: ANGPTL3; (-) strand; PAM type: NRG; PAM sequence: AAG
caattaggggaaatctgagt

SEQ ID NO: 7422 - DNA, 20 bp, Artificial Sequence
  Description of Artificial Sequence: Synthetic oligonucleotide
  Target: ANGPTL3; (-) strand; PAM type: NRG; PAM sequence: GAG
tatacaattaggggaaatct

SEQ ID NO: 7423 - DNA, 20 bp, Artificial Sequence
  Description of Artificial Sequence: Synthetic oligonucleotide
  Target: ANGPTL3; (-) strand; PAM type: NRG; PAM sequence: GGG
gatactgaatatacaattag

SEQ ID NO: 7424 - DNA, 20 bp, Artificial Sequence
  Description of Artificial Sequence: Synthetic oligonucleotide
  Target: ANGPTL3; (-) strand; PAM type: NRG; PAM sequence: GGG
tgatactgaatatacaatta

SEQ ID NO: 7425 - DNA, 20 bp, Artificial Sequence
  Description of Artificial Sequence: Synthetic oligonucleotide
  Target: ANGPTL3; (-) strand; PAM type: NRG; PAM sequence: AGG
atgatactgaatatacaatt

SEQ ID NO: 7426 - DNA, 20 bp, Artificial Sequence
  Description of Artificial Sequence: Synthetic oligonucleotide
  Target: ANGPTL3; (-) strand; PAM type: NRG; PAM sequence: TAG
aatgatactgaatatacaat

SEQ ID NO: 7427 - DNA, 20 bp, Artificial Sequence
  Description of Artificial Sequence: Synthetic oligonucleotide
  Target: ANGPTL3; (-) strand; PAM type: NRG; PAM sequence: AAG
tagtccttctgagctgataa

SEQ ID NO: 7428 - DNA, 20 bp, Artificial Sequence
  Description of Artificial Sequence: Synthetic oligonucleotide
  Target: ANGPTL3; (-) strand; PAM type: NRG; PAM sequence: GAG
tcttgaatactagtccttct

SEQ ID NO: 7429 - DNA, 20 bp, Artificial Sequence
  Description of Artificial Sequence: Synthetic oligonucleotide
  Target: ANGPTL3; (-) strand; PAM type: NRG; PAM sequence: TAG
ttctgtgggttcttgaatac

SEQ ID NO: 7430 - DNA, 20 bp, Artificial Sequence
  Description of Artificial Sequence: Synthetic oligonucleotide
  Target: ANGPTL3; (-) strand; PAM type: NRG; PAM sequence: GGG
gaagatagagaaatttctgt

SEQ ID NO: 7431 - DNA, 20 bp, Artificial Sequence
  Description of Artificial Sequence: Synthetic oligonucleotide
  Target: ANGPTL3; (-) strand; PAM type: NRG; PAM sequence: TGG
ggaagatagagaaatttctg

SEQ ID NO: 7432 - DNA, 20 bp, Artificial Sequence
  Description of Artificial Sequence: Synthetic oligonucleotide
  Target: ANGPTL3; (-) strand; PAM type: NRG; PAM sequence: GAG
tgctcttggcttggaagata

SEQ ID NO: 7433 - DNA, 20 bp, Artificial Sequence
  Description of Artificial Sequence: Synthetic oligonucleotide
  Target: ANGPTL3; (-) strand; PAM type: NRG; PAM sequence: TAG
ggtgctcttggcttggaaga

SEQ ID NO: 7434 - DNA, 20 bp, Artificial Sequence
  Description of Artificial Sequence: Synthetic oligonucleotide
  Target: ANGPTL3; (-) strand; PAM type: NRG; PAM sequence: AAG
tcttggtgctcttggcttgg

SEQ ID NO: 7435 - DNA, 20 bp, Artificial Sequence
  Description of Artificial Sequence: Synthetic oligonucleotide
  Target: ANGPTL3; (-) strand; PAM type: NRG; PAM sequence: TGG
agttcttggtgctcttggct

SEQ ID NO: 7436 - DNA, 20 bp, Artificial Sequence
  Description of Artificial Sequence: Synthetic oligonucleotide
  Target: ANGPTL3; (-) strand; PAM type: NRG; PAM sequence: TGG
ggagtagttcttggtgctct

SEQ ID NO: 7437 - DNA, 20 bp, Artificial Sequence
  Description of Artificial Sequence: Synthetic oligonucleotide
  Target: ANGPTL3; (-) strand; PAM type: NRG; PAM sequence: TGG
tgaagaaagggagtagttct

SEQ ID NO: 7438 - DNA, 20 bp, Artificial Sequence
  Description of Artificial Sequence: Synthetic oligonucleotide
  Target: ANGPTL3; (-) strand; PAM type: NRG; PAM sequence: TAG
attcaactgaagaaagggag

SEQ ID NO: 7439 - DNA, 20 bp, Artificial Sequence
  Description of Artificial Sequence: Synthetic oligonucleotide
  Target: ANGPTL3; (-) strand; PAM type: NRG; PAM sequence: GAG
ttcattcaactgaagaaagg

SEQ ID NO: 7440 - DNA, 20 bp, Artificial Sequence
  Description of Artificial Sequence: Synthetic oligonucleotide
  Target: ANGPTL3; (-) strand; PAM type: NRG; PAM sequence: GGG
atttcattcaactgaagaaa

SEQ ID NO: 7441 - DNA, 20 bp, Artificial Sequence
  Description of Artificial Sequence: Synthetic oligonucleotide
  Target: ANGPTL3; (-) strand; PAM type: NRG; PAM sequence: AGG
tatttcattcaactgaagaa

SEQ ID NO: 7442 - DNA, 20 bp, Artificial Sequence
  Description of Artificial Sequence: Synthetic oligonucleotide
  Target: ANGPTL3; (-) strand; PAM type: NRG; PAM sequence: AAG
ttatttcattcaactgaaga

SEQ ID NO: 7443 - DNA, 20 bp, Artificial Sequence
  Description of Artificial Sequence: Synthetic oligonucleotide
  Target: ANGPTL3; (-) strand; PAM type: NRG; PAM sequence: AAG
tttcttatttcattcaactg

SEQ ID NO: 7444 - DNA, 20 bp, Artificial Sequence
  Description of Artificial Sequence: Synthetic oligonucleotide
  Target: ANGPTL3; (-) strand; PAM type: NRG; PAM sequence: AAG
ttcaagaaggaaacccacca

SEQ ID NO: 7445 - DNA, 20 bp, Artificial Sequence
  Description of Artificial Sequence: Synthetic oligonucleotide
  Target: ANGPTL3; (-) strand; PAM type: NRG; PAM sequence: AGG
tgataataatagcttcaaga

SEQ ID NO: 7446 - DNA, 20 bp, Artificial Sequence
  Description of Artificial Sequence: Synthetic oligonucleotide
  Target: ANGPTL3; (-) strand; PAM type: NRG; PAM sequence: AAG
ttgataataatagcttcaag

SEQ ID NO: 7447 - DNA, 20 bp, Artificial Sequence
  Description of Artificial Sequence: Synthetic oligonucleotide
  Target: ANGPTL3; (-) strand; PAM type: NRG; PAM sequence: AAG
aatttgataataatagcttc

SEQ ID NO: 7448 - DNA, 20 bp, Artificial Sequence
  Description of Artificial Sequence: Synthetic oligonucleotide
  Target: ANGPTL3; (-) strand; PAM type: NRG; PAM sequence: TAG
aatagggaatttgataataa

SEQ ID NO: 7449 - DNA, 20 bp, Artificial Sequence
  Description of Artificial Sequence: Synthetic oligonucleotide
  Target: ANGPTL3; (-) strand; PAM type: NRG; PAM sequence: GGG
tagaacaagtcctaagaata

SEQ ID NO: 7450 - DNA, 20 bp, Artificial Sequence
  Description of Artificial Sequence: Synthetic oligonucleotide
  Target: ANGPTL3; (-) strand; PAM type: NRG; PAM sequence: AGG
ctagaacaagtcctaagaat

SEQ ID NO: 7451 - DNA, 20 bp, Artificial Sequence
  Description of Artificial Sequence: Synthetic oligonucleotide
  Target: ANGPTL3; (-) strand; PAM type: NRG; PAM sequence: TAG
tctagaacaagtcctaagaa

SEQ ID NO: 7452 - DNA, 20 bp, Artificial Sequence
  Description of Artificial Sequence: Synthetic oligonucleotide
  Target: ANGPTL3; (-) strand; PAM type: NRG; PAM sequence: AAG
tttagtctagaacaagtcct

SEQ ID NO: 7453 - DNA, 20 bp, Artificial Sequence
  Description of Artificial Sequence: Synthetic oligonucleotide
  Target: ANGPTL3; (-) strand; PAM type: NRG; PAM sequence: AAG
actatcttttagtctagaac

SEQ ID NO: 7454 - DNA, 20 bp, Artificial Sequence
  Description of Artificial Sequence: Synthetic oligonucleotide
  Target: ANGPTL3; (-) strand; PAM type: NRG; PAM sequence: TAG
ctcttaactatcttttagtc

SEQ ID NO: 7455 - DNA, 20 bp, Artificial Sequence
  Description of Artificial Sequence: Synthetic oligonucleotide
  Target: ANGPTL3; (-) strand; PAM type: NRG; PAM sequence: TAG
gatatctcttaactatcttt

SEQ ID NO: 7456 - DNA, 20 bp, Artificial Sequence
  Description of Artificial Sequence: Synthetic oligonucleotide
  Target: ANGPTL3; (-) strand; PAM type: NRG; PAM sequence: TGG
ggttgatacattgtatttga

SEQ ID NO: 7457 - DNA, 20 bp, Artificial Sequence
  Description of Artificial Sequence: Synthetic oligonucleotide
  Target: ANGPTL3; (-) strand; PAM type: NRG; PAM sequence: AGG
agaaccccagcatccagttt

SEQ ID NO: 7458 - DNA, 20 bp, Artificial Sequence
  Description of Artificial Sequence: Synthetic oligonucleotide
  Target: ANGPTL3; (-) strand; PAM type: NRG; PAM sequence: TAG
aagaaccccagcatccagtt

SEQ ID NO: 7459 - DNA, 20 bp, Artificial Sequence
  Description of Artificial Sequence: Synthetic oligonucleotide
  Target: ANGPTL3; (-) strand; PAM type: NRG; PAM sequence: CAG
gtaaaaagaaccccagcatc

SEQ ID NO: 7460 - DNA, 20 bp, Artificial Sequence
  Description of Artificial Sequence: Synthetic oligonucleotide
  Target: ANGPTL3; (-) strand; PAM type: NRG; PAM sequence: CAG
atagggtgtaaaaagaaccc

SEQ ID NO: 7461 - DNA, 20 bp, Artificial Sequence
  Description of Artificial Sequence: Synthetic oligonucleotide
  Target: ANGPTL3; (-) strand; PAM type: NRG; PAM sequence: AAG
tgtcttttatagggtgtaaa

SEQ ID NO: 7462 - DNA, 20 bp, Artificial Sequence
  Description of Artificial Sequence: Synthetic oligonucleotide
  Target: ANGPTL3; (-) strand; PAM type: NRG; PAM sequence: GGG
tcttaggtatgtcttttata

SEQ ID NO: 7463 - DNA, 20 bp, Artificial Sequence
  Description of Artificial Sequence: Synthetic oligonucleotide
  Target: ANGPTL3; (-) strand; PAM type: NRG; PAM sequence: AGG
gtcttaggtatgtcttttat

SEQ ID NO: 7464 - DNA, 20 bp, Artificial Sequence
  Description of Artificial Sequence: Synthetic oligonucleotide
  Target: ANGPTL3; (-) strand; PAM type: NRG; PAM sequence: TAG
tgtcttaggtatgtctttta

SEQ ID NO: 7465 - DNA, 20 bp, Artificial Sequence
  Description of Artificial Sequence: Synthetic oligonucleotide
  Target: ANGPTL3; (-) strand; PAM type: NRG; PAM sequence: AGG
tgtatttctctgattgtctt

SEQ ID NO: 7466 - DNA, 20 bp, Artificial Sequence
  Description of Artificial Sequence: Synthetic oligonucleotide
  Target: ANGPTL3; (-) strand; PAM type: NRG; PAM sequence: TAG
ttgtatttctctgattgtct

SEQ ID NO: 7467 - DNA, 20 bp, Artificial Sequence
  Description of Artificial Sequence: Synthetic oligonucleotide
  Target: ANGPTL3; (-) strand; PAM type: NRG; PAM sequence: AAG
ttctatattatctaataatc

SEQ ID NO: 7468 - DNA, 20 bp, Artificial Sequence
  Description of Artificial Sequence: Synthetic oligonucleotide
  Target: ANGPTL3; (-) strand; PAM type: NRG; PAM sequence: AAG
gcaataccatgatcacatct

SEQ ID NO: 7469 - DNA, 20 bp, Artificial Sequence
  Description of Artificial Sequence: Synthetic oligonucleotide
  Target: ANGPTL3; (-) strand; PAM type: NRG; PAM sequence: GAG
agcatgtatctcttaaacag

SEQ ID NO: 7470 - DNA, 20 bp, Artificial Sequence
  Description of Artificial Sequence: Synthetic oligonucleotide
  Target: ANGPTL3; (-) strand; PAM type: NRG; PAM sequence: AGG
tcagcatgtatctcttaaac

SEQ ID NO: 7471 - DNA, 20 bp, Artificial Sequence
  Description of Artificial Sequence: Synthetic oligonucleotide
  Target: ANGPTL3; (-) strand; PAM type: NRG; PAM sequence: CAG
ttcagcatgtatctcttaaa

SEQ ID NO: 7472 - DNA, 20 bp, Artificial Sequence
  Description of Artificial Sequence: Synthetic oligonucleotide
  Target: ANGPTL3; (-) strand; PAM type: NRG; PAM sequence: CAG
ctttaactccgtaaatattt

SEQ ID NO: 7473 - DNA, 20 bp, Artificial Sequence
  Description of Artificial Sequence: Synthetic oligonucleotide
  Target: ANGPTL3; (-) strand; PAM type: NRG; PAM sequence: CAG
tctatcaccagtctggagtc

SEQ ID NO: 7474 - DNA, 20 bp, Artificial Sequence
  Description of Artificial Sequence: Synthetic oligonucleotide
  Target: ANGPTL3; (-) strand; PAM type: NRG; PAM sequence: GAG
cttgttctatcaccagtctg

SEQ ID NO: 7475 - DNA, 20 bp, Artificial Sequence
  Description of Artificial Sequence: Synthetic oligonucleotide
  Target: ANGPTL3; (-) strand; PAM type: NRG; PAM sequence: TGG
gtcttgttctatcaccagtc

SEQ ID NO: 7476 - DNA, 20 bp, Artificial Sequence
  Description of Artificial Sequence: Synthetic oligonucleotide
  Target: ANGPTL3; (-) strand; PAM type: NRG; PAM sequence: CAG
acagagtcttgttctatcac

SEQ ID NO: 7477 - DNA, 20 bp, Artificial Sequence
  Description of Artificial Sequence: Synthetic oligonucleotide
  Target: ANGPTL3; (-) strand; PAM type: NRG; PAM sequence: GAG
ttaattattttttagagaca

SEQ ID NO: 7478 - DNA, 20 bp, Artificial Sequence
  Description of Artificial Sequence: Synthetic oligonucleotide
  Target: ANGPTL3; (-) strand; PAM type: NRG; PAM sequence: CAG
aattaattattttttagaga

SEQ ID NO: 7479 - DNA, 20 bp, Artificial Sequence
  Description of Artificial Sequence: Synthetic oligonucleotide
  Target: ANGPTL3; (-) strand; PAM type: NRG; PAM sequence: GAG
aaaaaattaattatttttta

SEQ ID NO: 7480 - DNA, 20 bp, Artificial Sequence
  Description of Artificial Sequence: Synthetic oligonucleotide
  Target: ANGPTL3; (-) strand; PAM type: NRG; PAM sequence: TAG
ttaaaaaattaattattttt

SEQ ID NO: 7481 - DNA, 20 bp, Artificial Sequence
  Description of Artificial Sequence: Synthetic oligonucleotide
  Target: ANGPTL3; (-) strand; PAM type: NRG; PAM sequence: AAG
ggcgtgttatttaagaatgt

SEQ ID NO: 7482 - DNA, 20 bp, Artificial Sequence
  Description of Artificial Sequence: Synthetic oligonucleotide
  Target: ANGPTL3; (-) strand; PAM type: NRG; PAM sequence: AAG
tcttagatggcgtgttattt

SEQ ID NO: 7483 - DNA, 20 bp, Artificial Sequence
  Description of Artificial Sequence: Synthetic oligonucleotide
  Target: ANGPTL3; (-) strand; PAM type: NRG; PAM sequence: TGG
gttaaagcatttttcttaga

SEQ ID NO: 7484 - DNA, 20 bp, Artificial Sequence
  Description of Artificial Sequence: Synthetic oligonucleotide
  Target: ANGPTL3; (-) strand; PAM type: NRG; PAM sequence: TAG
ttatgttaaagcatttttct

SEQ ID NO: 7485 - DNA, 20 bp, Artificial Sequence
  Description of Artificial Sequence: Synthetic oligonucleotide
  Target: ANGPTL3; (-) strand; PAM type: NRG; PAM sequence: AAG
tttcagtaatgtttatgtta

SEQ ID NO: 7486 - DNA, 20 bp, Artificial Sequence
  Description of Artificial Sequence: Synthetic oligonucleotide
  Target: ANGPTL3; (-) strand; PAM type: NRG; PAM sequence: CAG
tggcaaatgtagcatttttt

SEQ ID NO: 7487 - DNA, 20 bp, Artificial Sequence
  Description of Artificial Sequence: Synthetic oligonucleotide
  Target: ANGPTL3; (-) strand; PAM type: NRG; PAM sequence: TAG
ttatgaagttgtggcaaatg

SEQ ID NO: 7488 - DNA, 20 bp, Artificial Sequence
  Description of Artificial Sequence: Synthetic oligonucleotide
  Target: ANGPTL3; (-) strand; PAM type: NRG; PAM sequence: TGG
cttgacattttatgaagttg

SEQ ID NO: 7489 - DNA, 20 bp, Artificial Sequence
  Description of Artificial Sequence: Synthetic oligonucleotide
  Target: ANGPTL3; (-) strand; PAM type: NRG; PAM sequence: AAG
atttcacttgacattttatg

SEQ ID NO: 7490 - DNA, 20 bp, Artificial Sequence
  Description of Artificial Sequence: Synthetic oligonucleotide
  Target: ANGPTL3; (-) strand; PAM type: NRG; PAM sequence: GAG
gaataatatctttggagctt

SEQ ID NO: 7491 - DNA, 20 bp, Artificial Sequence
  Description of Artificial Sequence: Synthetic oligonucleotide
  Target: ANGPTL3; (-) strand; PAM type: NRG; PAM sequence: GAG
taataggaataatatctttg

SEQ ID NO: 7492 - DNA, 20 bp, Artificial Sequence
  Description of Artificial Sequence: Synthetic oligonucleotide
  Target: ANGPTL3; (-) strand; PAM type: NRG; PAM sequence: TGG
agtaataggaataatatctt

SEQ ID NO: 7493 - DNA, 20 bp, Artificial Sequence
  Description of Artificial Sequence: Synthetic oligonucleotide
  Target: ANGPTL3; (-) strand; PAM type: NRG; PAM sequence: AGG
attacatcagatttagtaat

SEQ ID NO: 7494 - DNA, 20 bp, Artificial Sequence
  Description of Artificial Sequence: Synthetic oligonucleotide
  Target: ANGPTL3; (-) strand; PAM type: NRG; PAM sequence: TAG
tattacatcagatttagtaa

SEQ ID NO: 7495 - DNA, 20 bp, Artificial Sequence
  Description of Artificial Sequence: Synthetic oligonucleotide
  Target: ANGPTL3; (-) strand; PAM type: NRG; PAM sequence: TAG
aaatgttattacatcagatt

SEQ ID NO: 7496 - DNA, 20 bp, Artificial Sequence
  Description of Artificial Sequence: Synthetic oligonucleotide
  Target: ANGPTL3; (-) strand; PAM type: NRG; PAM sequence: CAG
tcaataaaatgttattacat

SEQ ID NO: 7497 - DNA, 20 bp, Artificial Sequence
  Description of Artificial Sequence: Synthetic oligonucleotide
  Target: ANGPTL3; (-) strand; PAM type: NRG; PAM sequence: TAG
gtacattcagcaggaatgcc

SEQ ID NO: 7498 - DNA, 20 bp, Artificial Sequence
  Description of Artificial Sequence: Synthetic oligonucleotide
  Target: ANGPTL3; (-) strand; PAM type: NRG; PAM sequence: AGG
taaatggtggtacattcagc

SEQ ID NO: 7499 - DNA, 20 bp, Artificial Sequence
  Description of Artificial Sequence: Synthetic oligonucleotide
  Target: ANGPTL3; (-) strand; PAM type: NRG; PAM sequence: CAG
ataaatggtggtacattcag

SEQ ID NO: 7500 - DNA, 20 bp, Artificial Sequence
  Description of Artificial Sequence: Synthetic oligonucleotide
  Target: ANGPTL3; (-) strand; PAM type: NRG; PAM sequence: CAG
gttataaatggtggtacatt

SEQ ID NO: 7501 - DNA, 20 bp, Artificial Sequence
  Description of Artificial Sequence: Synthetic oligonucleotide
  Target: ANGPTL3; (-) strand; PAM type: NRG; PAM sequence: TGG
ttcacctctgttataaatgg

SEQ ID NO: 7502 - DNA, 20 bp, Artificial Sequence
  Description of Artificial Sequence: Synthetic oligonucleotide
  Target: ANGPTL3; (-) strand; PAM type: NRG; PAM sequence: TGG
atgttcacctctgttataaa

SEQ ID NO: 7503 - DNA, 20 bp, Artificial Sequence
  Description of Artificial Sequence: Synthetic oligonucleotide
  Target: ANGPTL3; (-) strand; PAM type: NRG; PAM sequence: TGG
ttgagagttgctgggtctga

SEQ ID NO: 7504 - DNA, 20 bp, Artificial Sequence
  Description of Artificial Sequence: Synthetic oligonucleotide
  Target: ANGPTL3; (-) strand; PAM type: NRG; PAM sequence: GGG
tgaaaaacttgagagttgct

SEQ ID NO: 7505 - DNA, 20 bp, Artificial Sequence
  Description of Artificial Sequence: Synthetic oligonucleotide
  Target: ANGPTL3; (-) strand; PAM type: NRG; PAM sequence: TGG
atgaaaaacttgagagttgc

SEQ ID NO: 7506 - DNA, 20 bp, Artificial Sequence
  Description of Artificial Sequence: Synthetic oligonucleotide
  Target: ANGPTL3; (-) strand; PAM type: NRG; PAM sequence: GAG
agtagacatgaaaaacttga

SEQ ID NO: 7507 - DNA, 20 bp, Artificial Sequence
  Description of Artificial Sequence: Synthetic oligonucleotide
  Target: ANGPTL3; (-) strand; PAM type: NRG; PAM sequence: GAG
acagtagacatgaaaaactt

SEQ ID NO: 7508 - DNA, 20 bp, Artificial Sequence
  Description of Artificial Sequence: Synthetic oligonucleotide
  Target: ANGPTL3; (-) strand; PAM type: NRG; PAM sequence: TAG
tacctgatataacatcacag

SEQ ID NO: 7509 - DNA, 20 bp, Artificial Sequence
  Description of Artificial Sequence: Synthetic oligonucleotide
  Target: ANGPTL3; (-) strand; PAM type: NRG; PAM sequence: CAG
ttttacctgatataacatca

SEQ ID NO: 7510 - DNA, 20 bp, Artificial Sequence
  Description of Artificial Sequence: Synthetic oligonucleotide
  Target: ANGPTL3; (-) strand; PAM type: NRG; PAM sequence: AGG
actgtctattctccttagac

SEQ ID NO: 7511 - DNA, 20 bp, Artificial Sequence
  Description of Artificial Sequence: Synthetic oligonucleotide
  Target: ANGPTL3; (-) strand; PAM type: NRG; PAM sequence: CAG
tactgtctattctccttaga

SEQ ID NO: 7512 - DNA, 20 bp, Artificial Sequence
  Description of Artificial Sequence: Synthetic oligonucleotide
  Target: ANGPTL3; (-) strand; PAM type: NRG; PAM sequence: TAG
taactactgtctattctcct

SEQ ID NO: 7513 - DNA, 20 bp, Artificial Sequence
  Description of Artificial Sequence: Synthetic oligonucleotide
  Target: ANGPTL3; (-) strand; PAM type: NRG; PAM sequence: AAG
cttcctaatacgtaatgagt

SEQ ID NO: 7514 - DNA, 20 bp, Artificial Sequence
  Description of Artificial Sequence: Synthetic oligonucleotide
  Target: ANGPTL3; (-) strand; PAM type: NRG; PAM sequence: GAG
taatcttcctaatacgtaat

SEQ ID NO: 7515 - DNA, 20 bp, Artificial Sequence
  Description of Artificial Sequence: Synthetic oligonucleotide
  Target: ANGPTL3; (-) strand; PAM type: NRG; PAM sequence: AGG
tgtataaaacaatgataacc

SEQ ID NO: 7516 - DNA, 20 bp, Artificial Sequence
  Description of Artificial Sequence: Synthetic oligonucleotide
  Target: ANGPTL3; (-) strand; PAM type: NRG; PAM sequence: CAG
atgtataaaacaatgataac

SEQ ID NO: 7517 - DNA, 20 bp, Artificial Sequence
  Description of Artificial Sequence: Synthetic oligonucleotide
  Target: ANGPTL3; (-) strand; PAM type: NRG; PAM sequence: AAG
taaatacataaacaaggtaa

SEQ ID NO: 7518 - DNA, 20 bp, Artificial Sequence
  Description of Artificial Sequence: Synthetic oligonucleotide
  Target: ANGPTL3; (-) strand; PAM type: NRG; PAM sequence: AGG
attgagtaaatacataaaca

SEQ ID NO: 7519 - DNA, 20 bp, Artificial Sequence
  Description of Artificial Sequence: Synthetic oligonucleotide
  Target: ANGPTL3; (-) strand; PAM type: NRG; PAM sequence: AAG
tattgagtaaatacataaac

SEQ ID NO: 7520 - DNA, 20 bp, Artificial Sequence
  Description of Artificial Sequence: Synthetic oligonucleotide
  Target: ANGPTL3; (-) strand; PAM type: NRG; PAM sequence: GAG
tagaggaaaaggagaatatt

SEQ ID NO: 7521 - DNA, 20 bp, Artificial Sequence
  Description of Artificial Sequence: Synthetic oligonucleotide
  Target: ANGPTL3; (-) strand; PAM type: NRG; PAM sequence: GAG
agattattttagaggaaaag

SEQ ID NO: 7522 - DNA, 20 bp, Artificial Sequence
  Description of Artificial Sequence: Synthetic oligonucleotide
  Target: ANGPTL3; (-) strand; PAM type: NRG; PAM sequence: AGG
tcagattattttagaggaaa

SEQ ID NO: 7523 - DNA, 20 bp, Artificial Sequence
  Description of Artificial Sequence: Synthetic oligonucleotide
  Target: ANGPTL3; (-) strand; PAM type: NRG; PAM sequence: AAG
ttcagattattttagaggaa

SEQ ID NO: 7524 - DNA, 20 bp, Artificial Sequence
  Description of Artificial Sequence: Synthetic oligonucleotide
  Target: ANGPTL3; (-) strand; PAM type: NRG; PAM sequence: AGG
gtcacttcagattattttag

SEQ ID NO: 7525 - DNA, 20 bp, Artificial Sequence
  Description of Artificial Sequence: Synthetic oligonucleotide
  Target: ANGPTL3; (-) strand; PAM type: NRG; PAM sequence: GAG
agtcacttcagattatttta

SEQ ID NO: 7526 - DNA, 20 bp, Artificial Sequence
  Description of Artificial Sequence: Synthetic oligonucleotide
  Target: ANGPTL3; (-) strand; PAM type: NRG; PAM sequence: TAG
atagtcacttcagattattt

SEQ ID NO: 7527 - DNA, 20 bp, Artificial Sequence
  Description of Artificial Sequence: Synthetic oligonucleotide
  Target: ANGPTL3; (-) strand; PAM type: NRG; PAM sequence: CAG
cttattgataatagtcactt

SEQ ID NO: 7528 - DNA, 20 bp, Artificial Sequence
  Description of Artificial Sequence: Synthetic oligonucleotide
  Target: ANGPTL3; (-) strand; PAM type: NRG; PAM sequence: TAG
catagtaaacttattgataa

SEQ ID NO: 7529 - DNA, 20 bp, Artificial Sequence
  Description of Artificial Sequence: Synthetic oligonucleotide
  Target: ANGPTL3; (-) strand; PAM type: NRG; PAM sequence: TAG
gcaattaatgaattttggca

SEQ ID NO: 7530 - DNA, 20 bp, Artificial Sequence
  Description of Artificial Sequence: Synthetic oligonucleotide
  Target: ANGPTL3; (-) strand; PAM type: NRG; PAM sequence: TGG
gaaaggcaattaatgaattt

SEQ ID NO: 7531 - DNA, 20 bp, Artificial Sequence
  Description of Artificial Sequence: Synthetic oligonucleotide
  Target: ANGPTL3; (-) strand; PAM type: NRG; PAM sequence: AGG
ggtcccaaaagttaagtgaa

SEQ ID NO: 7532 - DNA, 20 bp, Artificial Sequence
  Description of Artificial Sequence: Synthetic oligonucleotide
  Target: ANGPTL3; (-) strand; PAM type: NRG; PAM sequence: AAG
tggtcccaaaagttaagtga

SEQ ID NO: 7533 - DNA, 20 bp, Artificial Sequence
  Description of Artificial Sequence: Synthetic oligonucleotide
  Target: ANGPTL3; (-) strand; PAM type: NRG; PAM sequence: AAG
ttattatggtcccaaaagtt

SEQ ID NO: 7534 - DNA, 20 bp, Artificial Sequence
  Description of Artificial Sequence: Synthetic oligonucleotide
  Target: ANGPTL3; (-) strand; PAM type: NRG; PAM sequence: AAG
attatttattatggtcccaa

SEQ ID NO: 7535 - DNA, 20 bp, Artificial Sequence
  Description of Artificial Sequence: Synthetic oligonucleotide
  Target: ANGPTL3; (-) strand; PAM type: NRG; PAM sequence: TGG
atacattttattatttatta

SEQ ID NO: 7536 - DNA, 20 bp, Artificial Sequence
  Description of Artificial Sequence: Synthetic oligonucleotide
  Target: ANGPTL3; (-) strand; PAM type: NRG; PAM sequence: TGG
aaggtagtttattaatgtta

SEQ ID NO: 7537 - DNA, 20 bp, Artificial Sequence
  Description of Artificial Sequence: Synthetic oligonucleotide
  Target: ANGPTL3; (-) strand; PAM type: NRG; PAM sequence: TAG
taattggtggttttgtaagg

SEQ ID NO: 7538 - DNA, 20 bp, Artificial Sequence
  Description of Artificial Sequence: Synthetic oligonucleotide
  Target: ANGPTL3; (-) strand; PAM type: NRG; PAM sequence: AGG
ttttaattggtggttttgta

SEQ ID NO: 7539 - DNA, 20 bp, Artificial Sequence
  Description of Artificial Sequence: Synthetic oligonucleotide
  Target: ANGPTL3; (-) strand; PAM type: NRG; PAM sequence: AAG
attttaattggtggttttgt

SEQ ID NO: 7540 - DNA, 20 bp, Artificial Sequence
  Description of Artificial Sequence: Synthetic oligonucleotide
  Target: ANGPTL3; (-) strand; PAM type: NRG; PAM sequence: TGG
gtttgtttgattttaattgg

SEQ ID NO: 7541 - DNA, 20 bp, Artificial Sequence
  Description of Artificial Sequence: Synthetic oligonucleotide
  Target: ANGPTL3; (-) strand; PAM type: NRG; PAM sequence: TGG
tttgtttgtttgattttaat

SEQ ID NO: 7542 - DNA, 20 bp, Artificial Sequence
  Description of Artificial Sequence: Synthetic oligonucleotide
  Target: ANGPTL3; (-) strand; PAM type: NRG; PAM sequence: CAG
ttttagtagatttatgttga

SEQ ID NO: 7543 - DNA, 20 bp, Artificial Sequence
  Description of Artificial Sequence: Synthetic oligonucleotide
  Target: ANGPTL3; (-) strand; PAM type: NRG; PAM sequence: TAG
atgaaatcatgtatttttag

SEQ ID NO: 7544 - DNA, 20 bp, Artificial Sequence
  Description of Artificial Sequence: Synthetic oligonucleotide
  Target: ANGPTL3; (-) strand; PAM type: NRG; PAM sequence: TAG
tgaatgaaatcatgtatttt

SEQ ID NO: 7545 - DNA, 20 bp, Artificial Sequence
  Description of Artificial Sequence: Synthetic oligonucleotide
  Target: ANGPTL3; (-) strand; PAM type: NRG; PAM sequence: TGG
cgatgttgaattaatgtcca

SEQ ID NO: 7546 - DNA, 20 bp, Artificial Sequence
  Description of Artificial Sequence: Synthetic oligonucleotide
  Target: ANGPTL3; (-) strand; PAM type: NRG; PAM sequence: AAG
agttctcccacgtttcattg

SEQ ID NO: 7547 - DNA, 20 bp, Artificial Sequence
  Description of Artificial Sequence: Synthetic oligonucleotide
  Target: ANGPTL3; (-) strand; PAM type: NRG; PAM sequence: TAG
gcctcccaaaaccatatttg

SEQ ID NO: 7548 - DNA, 20 bp, Artificial Sequence
  Description of Artificial Sequence: Synthetic oligonucleotide
  Target: ANGPTL3; (-) strand; PAM type: NRG; PAM sequence: AAG
aatgtagtccccttaccatc

SEQ ID NO: 7549 - DNA, 20 bp, Artificial Sequence
  Description of Artificial Sequence: Synthetic oligonucleotide
  Target: ANGPTL3; (-) strand; PAM type: NRG; PAM sequence: TAG
agtgaatgaatgattgaatg

SEQ ID NO: 7550 - DNA, 20 bp, Artificial Sequence
  Description of Artificial Sequence: Synthetic oligonucleotide
  Target: ANGPTL3; (-) strand; PAM type: NRG; PAM sequence: AAG
gtaaatatttgtagattagc

SEQ ID NO: 7551 - DNA, 20 bp, Artificial Sequence
  Description of Artificial Sequence: Synthetic oligonucleotide
  Target: ANGPTL3; (-) strand; PAM type: NRG; PAM sequence: TAG
ctcagtaaatatttgtagat

SEQ ID NO: 7552 - DNA, 20 bp, Artificial Sequence
  Description of Artificial Sequence: Synthetic oligonucleotide
  Target: ANGPTL3; (-) strand; PAM type: NRG; PAM sequence: TAG
aggttctcagtaaatatttg

SEQ ID NO: 7553 - DNA, 20 bp, Artificial Sequence
  Description of Artificial Sequence: Synthetic oligonucleotide
  Target: ANGPTL3; (-) strand; PAM type: NRG; PAM sequence: CAG
cctggtccataagaggttct

SEQ ID NO: 7554 - DNA, 20 bp, Artificial Sequence
  Description of Artificial Sequence: Synthetic oligonucleotide
  Target: ANGPTL3; (-) strand; PAM type: NRG; PAM sequence: AGG
cctaatacctggtccataag

SEQ ID NO: 7555 - DNA, 20 bp, Artificial Sequence
  Description of Artificial Sequence: Synthetic oligonucleotide
  Target: ANGPTL3; (-) strand; PAM type: NRG; PAM sequence: GAG
tcctaatacctggtccataa

SEQ ID NO: 7556 - DNA, 20 bp, Artificial Sequence
  Description of Artificial Sequence: Synthetic oligonucleotide
  Target: ANGPTL3; (-) strand; PAM type: NRG; PAM sequence: AAG
tttcctaatacctggtccat

SEQ ID NO: 7557 - DNA, 20 bp, Artificial Sequence
  Description of Artificial Sequence: Synthetic oligonucleotide
  Target: ANGPTL3; (-) strand; PAM type: NRG; PAM sequence: TGG
ttactacttttcctaatacc

SEQ ID NO: 7558 - DNA, 20 bp, Artificial Sequence
  Description of Artificial Sequence: Synthetic oligonucleotide
  Target: ANGPTL3; (-) strand; PAM type: NRG; PAM sequence: GAG
taataaattatatgaaggct

SEQ ID NO: 7559 - DNA, 20 bp, Artificial Sequence
  Description of Artificial Sequence: Synthetic oligonucleotide
  Target: ANGPTL3; (-) strand; PAM type: NRG; PAM sequence: AGG
tttgataataaattatatga

SEQ ID NO: 7560 - DNA, 20 bp, Artificial Sequence
  Description of Artificial Sequence: Synthetic oligonucleotide
  Target: ANGPTL3; (-) strand; PAM type: NRG; PAM sequence: AAG
gtttgataataaattatatg

SEQ ID NO: 7561 - DNA, 20 bp, Artificial Sequence
  Description of Artificial Sequence: Synthetic oligonucleotide
  Target: ANGPTL3; (-) strand; PAM type: NRG; PAM sequence: AAG
caaataataacagttgtaat

SEQ ID NO: 7562 - DNA, 20 bp, Artificial Sequence
  Description of Artificial Sequence: Synthetic oligonucleotide
  Target: ANGPTL3; (-) strand; PAM type: NRG; PAM sequence: CAG
aaatataattcaaataataa

SEQ ID NO: 7563 - DNA, 20 bp, Artificial Sequence
  Description of Artificial Sequence: Synthetic oligonucleotide
  Target: ANGPTL3; (-) strand; PAM type: NRG; PAM sequence: CAG
gtgataagtatatttaagaa

SEQ ID NO: 7564 - DNA, 20 bp, Artificial Sequence
  Description of Artificial Sequence: Synthetic oligonucleotide
  Target: ANGPTL3; (-) strand; PAM type: NRG; PAM sequence: AAG
aaattgtgataagtatattt

SEQ ID NO: 7565 - DNA, 20 bp, Artificial Sequence
  Description of Artificial Sequence: Synthetic oligonucleotide
  Target: ANGPTL3; (-) strand; PAM type: NRG; PAM sequence: AAG
ccgtggaattaaattgtgat

SEQ ID NO: 7566 - DNA, 20 bp, Artificial Sequence
  Description of Artificial Sequence: Synthetic oligonucleotide
  Target: ANGPTL3; (-) strand; PAM type: NRG; PAM sequence: TGG
gttatgatcattgtaagccg

SEQ ID NO: 7567 - DNA, 20 bp, Artificial Sequence
  Description of Artificial Sequence: Synthetic oligonucleotide
  Target: ANGPTL3; (-) strand; PAM type: NRG; PAM sequence: AAG
attatagttatgatcattgt

SEQ ID NO: 7568 - DNA, 20 bp, Artificial Sequence
  Description of Artificial Sequence: Synthetic oligonucleotide
  Target: ANGPTL3; (-) strand; PAM type: NRG; PAM sequence: TAG
aaaattgtctttaataatta

SEQ ID NO: 7569 - DNA, 20 bp, Artificial Sequence
  Description of Artificial Sequence: Synthetic oligonucleotide
  Target: ANGPTL3; (-) strand; PAM type: NRG; PAM sequence: CAG
ttttcacagcttatttgtaa

SEQ ID NO: 7570 - DNA, 20 bp, Artificial Sequence
  Description of Artificial Sequence: Synthetic oligonucleotide
  Target: ANGPTL3; (-) strand; PAM type: NRG; PAM sequence: CAG
gctaggagtggttcttttca

SEQ ID NO: 7571 - DNA, 20 bp, Artificial Sequence
  Description of Artificial Sequence: Synthetic oligonucleotide
  Target: ANGPTL3; (-) strand; PAM type: NRG; PAM sequence: TGG
agagtgactaatgctaggag

SEQ ID NO: 7572 - DNA, 20 bp, Artificial Sequence
  Description of Artificial Sequence: Synthetic oligonucleotide
  Target: ANGPTL3; (-) strand; PAM type: NRG; PAM sequence: GAG
aatagagtgactaatgctag

SEQ ID NO: 7573 - DNA, 20 bp, Artificial Sequence
  Description of Artificial Sequence: Synthetic oligonucleotide
  Target: ANGPTL3; (-) strand; PAM type: NRG; PAM sequence: AGG
agaatagagtgactaatgct

SEQ ID NO: 7574 - DNA, 20 bp, Artificial Sequence
  Description of Artificial Sequence: Synthetic oligonucleotide
  Target: ANGPTL3; (-) strand; PAM type: NRG; PAM sequence: TAG
gagaatagagtgactaatgc

SEQ ID NO: 7575 - DNA, 20 bp, Artificial Sequence
  Description of Artificial Sequence: Synthetic oligonucleotide
  Target: ANGPTL3; (-) strand; PAM type: NRG; PAM sequence: GAG
aaaacgttaatgagagaata

SEQ ID NO: 7576 - DNA, 20 bp, Artificial Sequence
  Description of Artificial Sequence: Synthetic oligonucleotide
  Target: ANGPTL3; (-) strand; PAM type: NRG; PAM sequence: TAG
gtaaaacgttaatgagagaa

SEQ ID NO: 7577 - DNA, 20 bp, Artificial Sequence
  Description of Artificial Sequence: Synthetic oligonucleotide
  Target: ANGPTL3; (-) strand; PAM type: NRG; PAM sequence: GAG
gatatgtaaaacgttaatga

SEQ ID NO: 7578 - DNA, 20 bp, Artificial Sequence
  Description of Artificial Sequence: Synthetic oligonucleotide
  Target: ANGPTL3; (-) strand; PAM type: NRG; PAM sequence: GAG
ttgatatgtaaaacgttaat

SEQ ID NO: 7579 - DNA, 20 bp, Artificial Sequence
  Description of Artificial Sequence: Synthetic oligonucleotide
  Target: ANGPTL3; (-) strand; PAM type: NRG; PAM sequence: TGG
tactgtatgtctgagtttcc

SEQ ID NO: 7580 - DNA, 20 bp, Artificial Sequence
  Description of Artificial Sequence: Synthetic oligonucleotide
  Target: ANGPTL3; (-) strand; PAM type: NRG; PAM sequence: GAG
aaaatgtatactgtatgtct

SEQ ID NO: 7581 - DNA, 20 bp, Artificial Sequence
  Description of Artificial Sequence: Synthetic oligonucleotide
  Target: ANGPTL3; (-) strand; PAM type: NRG; PAM sequence: AAG
tgagttaactaattcattat

SEQ ID NO: 7582 - DNA, 20 bp, Artificial Sequence
  Description of Artificial Sequence: Synthetic oligonucleotide
  Target: ANGPTL3; (-) strand; PAM type: NRG; PAM sequence: GAG
aaaatagaataatttgcatt

SEQ ID NO: 7583 - DNA, 20 bp, Artificial Sequence
  Description of Artificial Sequence: Synthetic oligonucleotide
  Target: ANGPTL3; (-) strand; PAM type: NRG; PAM sequence: TAG
tttactatttgtaatcaaaa

SEQ ID NO: 7584 - DNA, 20 bp, Artificial Sequence
  Description of Artificial Sequence: Synthetic oligonucleotide
  Target: ANGPTL3; (-) strand; PAM type: NRG; PAM sequence: TGG
ggatttttgtatgtgctttt

SEQ ID NO: 7585 - DNA, 20 bp, Artificial Sequence
  Description of Artificial Sequence: Synthetic oligonucleotide
  Target: ANGPTL3; (-) strand; PAM type: NRG; PAM sequence: TGG
gagtacttagacatcattca

SEQ ID NO: 7586 - DNA, 20 bp, Artificial Sequence
  Description of Artificial Sequence: Synthetic oligonucleotide
  Target: ANGPTL3; (-) strand; PAM type: NRG; PAM sequence: TAG
ctactttataagtgagtact

SEQ ID NO: 7587 - DNA, 20 bp, Artificial Sequence
  Description of Artificial Sequence: Synthetic oligonucleotide
  Target: ANGPTL3; (-) strand; PAM type: NRG; PAM sequence: GAG
atgtcttctactttataagt

SEQ ID NO: 7588 - DNA, 20 bp, Artificial Sequence
  Description of Artificial Sequence: Synthetic oligonucleotide
  Target: ANGPTL3; (-) strand; PAM type: NRG; PAM sequence: AAG
atgaatgtcttctactttat

SEQ ID NO: 7589 - DNA, 20 bp, Artificial Sequence
  Description of Artificial Sequence: Synthetic oligonucleotide
  Target: ANGPTL3; (-) strand; PAM type: NRG; PAM sequence: GAG
ttaaatggtcaaatagtact

SEQ ID NO: 7590 - DNA, 20 bp, Artificial Sequence
  Description of Artificial Sequence: Synthetic oligonucleotide
  Target: ANGPTL3; (-) strand; PAM type: NRG; PAM sequence: TAG
aaaatttttaaatggtcaaa

SEQ ID NO: 7591 - DNA, 20 bp, Artificial Sequence
  Description of Artificial Sequence: Synthetic oligonucleotide
  Target: ANGPTL3; (-) strand; PAM type: NRG; PAM sequence: TGG
ttgaatacaaaatttttaaa

SEQ ID NO: 7592 - DNA, 20 bp, Artificial Sequence
  Description of Artificial Sequence: Synthetic oligonucleotide
  Target: ANGPTL3; (-) strand; PAM type: NRG; PAM sequence: TAG
ctaggtagggctttcactgg

SEQ ID NO: 7593 - DNA, 20 bp, Artificial Sequence
  Description of Artificial Sequence: Synthetic oligonucleotide
  Target: ANGPTL3; (-) strand; PAM type: NRG; PAM sequence: TGG
cttctaggtagggctttcac

SEQ ID NO: 7594 - DNA, 20 bp, Artificial Sequence
  Description of Artificial Sequence: Synthetic oligonucleotide
  Target: ANGPTL3; (-) strand; PAM type: NRG; PAM sequence: GGG
ctgagtataccttctaggta

SEQ ID NO: 7595 - DNA, 20 bp, Artificial Sequence
  Description of Artificial Sequence: Synthetic oligonucleotide
  Target: ANGPTL3; (-) strand; PAM type: NRG; PAM sequence: AGG
actgagtataccttctaggt

SEQ ID NO: 7596 - DNA, 20 bp, Artificial Sequence
  Description of Artificial Sequence: Synthetic oligonucleotide
  Target: ANGPTL3; (-) strand; PAM type: NRG; PAM sequence: TAG
cactgagtataccttctagg

SEQ ID NO: 7597 - DNA, 20 bp, Artificial Sequence
  Description of Artificial Sequence: Synthetic oligonucleotide
  Target: ANGPTL3; (-) strand; PAM type: NRG; PAM sequence: AGG
tatcactgagtataccttct

SEQ ID NO: 7598 - DNA, 20 bp, Artificial Sequence
  Description of Artificial Sequence: Synthetic oligonucleotide
  Target: ANGPTL3; (-) strand; PAM type: NRG; PAM sequence: TAG
ttatcactgagtataccttc

SEQ ID NO: 7599 - DNA, 20 bp, Artificial Sequence
  Description of Artificial Sequence: Synthetic oligonucleotide
  Target: ANGPTL3; (-) strand; PAM type: NRG; PAM sequence: GAG
gagctacaaaacttatcact

SEQ ID NO: 7600 - DNA, 20 bp, Artificial Sequence
  Description of Artificial Sequence: Synthetic oligonucleotide
  Target: ANGPTL3; (-) strand; PAM type: NRG; PAM sequence: GAG
actcactattagaagatttg

SEQ ID NO: 7601 - DNA, 20 bp, Artificial Sequence
  Description of Artificial Sequence: Synthetic oligonucleotide
  Target: ANGPTL3; (-) strand; PAM type: NRG; PAM sequence: TGG
acactcactattagaagatt

SEQ ID NO: 7602 - DNA, 20 bp, Artificial Sequence
  Description of Artificial Sequence: Synthetic oligonucleotide
  Target: ANGPTL3; (-) strand; PAM type: NRG; PAM sequence: AAG
ggggttacactcactattag

SEQ ID NO: 7603 - DNA, 20 bp, Artificial Sequence
  Description of Artificial Sequence: Synthetic oligonucleotide
  Target: ANGPTL3; (-) strand; PAM type: NRG; PAM sequence: TAG
tttggggttacactcactat

SEQ ID NO: 7604 - DNA, 20 bp, Artificial Sequence
  Description of Artificial Sequence: Synthetic oligonucleotide
  Target: ANGPTL3; (-) strand; PAM type: NRG; PAM sequence: GGG
cctgtcagccttttattttg

SEQ ID NO: 7605 - DNA, 20 bp, Artificial Sequence
  Description of Artificial Sequence: Synthetic oligonucleotide
  Target: ANGPTL3; (-) strand; PAM type: NRG; PAM sequence: GGG
acctgtcagccttttatttt

SEQ ID NO: 7606 - DNA, 20 bp, Artificial Sequence
  Description of Artificial Sequence: Synthetic oligonucleotide
  Target: ANGPTL3; (-) strand; PAM type: NRG; PAM sequence: TGG
tacctgtcagccttttattt

SEQ ID NO: 7607 - DNA, 20 bp, Artificial Sequence
  Description of Artificial Sequence: Synthetic oligonucleotide
  Target: ANGPTL3; (-) strand; PAM type: NRG; PAM sequence: CAG
agtattctcgacttacctgt

SEQ ID NO: 7608 - DNA, 20 bp, Artificial Sequence
  Description of Artificial Sequence: Synthetic oligonucleotide
  Target: ANGPTL3; (-) strand; PAM type: NRG; PAM sequence: GAG
ctttcttaccagaattaagt

SEQ ID NO: 7609 - DNA, 20 bp, Artificial Sequence
  Description of Artificial Sequence: Synthetic oligonucleotide
  Target: ANGPTL3; (-) strand; PAM type: NRG; PAM sequence: AAG
gttgctttcttaccagaatt

SEQ ID NO: 7610 - DNA, 20 bp, Artificial Sequence
  Description of Artificial Sequence: Synthetic oligonucleotide
  Target: ANGPTL3; (-) strand; PAM type: NRG; PAM sequence: CAG
caaatgggttgctttcttac

SEQ ID NO: 7611 - DNA, 20 bp, Artificial Sequence
  Description of Artificial Sequence: Synthetic oligonucleotide
  Target: ANGPTL3; (-) strand; PAM type: NRG; PAM sequence: GGG
tggtaaatacaagtacaaat

SEQ ID NO: 7612 - DNA, 20 bp, Artificial Sequence
  Description of Artificial Sequence: Synthetic oligonucleotide
  Target: ANGPTL3; (-) strand; PAM type: NRG; PAM sequence: TGG
ctggtaaatacaagtacaaa

SEQ ID NO: 7613 - DNA, 20 bp, Artificial Sequence
  Description of Artificial Sequence: Synthetic oligonucleotide
  Target: ANGPTL3; (-) strand; PAM type: NRG; PAM sequence: AAG
taaggattgctggtaaatac

SEQ ID NO: 7614 - DNA, 20 bp, Artificial Sequence
  Description of Artificial Sequence: Synthetic oligonucleotide
  Target: ANGPTL3; (-) strand; PAM type: NRG; PAM sequence: TGG
agcttcattttaaggattgc

SEQ ID NO: 7615 - DNA, 20 bp, Artificial Sequence
  Description of Artificial Sequence: Synthetic oligonucleotide
  Target: ANGPTL3; (-) strand; PAM type: NRG; PAM sequence: AGG
tagtaggaagcttcatttta

SEQ ID NO: 7616 - DNA, 20 bp, Artificial Sequence
  Description of Artificial Sequence: Synthetic oligonucleotide
  Target: ANGPTL3; (-) strand; PAM type: NRG; PAM sequence: AAG
ttagtaggaagcttcatttt

SEQ ID NO: 7617 - DNA, 20 bp, Artificial Sequence
  Description of Artificial Sequence: Synthetic oligonucleotide
  Target: ANGPTL3; (-) strand; PAM type: NRG; PAM sequence: AAG
attgctattgagttagtagg

SEQ ID NO: 7618 - DNA, 20 bp, Artificial Sequence
  Description of Artificial Sequence: Synthetic oligonucleotide
  Target: ANGPTL3; (-) strand; PAM type: NRG; PAM sequence: AGG
cttattgctattgagttagt

SEQ ID NO: 7619 - DNA, 20 bp, Artificial Sequence
  Description of Artificial Sequence: Synthetic oligonucleotide
  Target: ANGPTL3; (-) strand; PAM type: NRG; PAM sequence: TAG
tcttattgctattgagttag

SEQ ID NO: 7620 - DNA, 20 bp, Artificial Sequence
  Description of Artificial Sequence: Synthetic oligonucleotide
  Target: ANGPTL3; (-) strand; PAM type: NRG; PAM sequence: TAG
ttgtcttattgctattgagt

SEQ ID NO: 7621 - DNA, 20 bp, Artificial Sequence
  Description of Artificial Sequence: Synthetic oligonucleotide
  Target: ANGPTL3; (-) strand; PAM type: NRG; PAM sequence: GAG
actattgtcttattgctatt

SEQ ID NO: 7622 - DNA, 20 bp, Artificial Sequence
  Description of Artificial Sequence: Synthetic oligonucleotide
  Target: ANGPTL3; (-) strand; PAM type: NRG; PAM sequence: AAG
catcacaatcctttttatta

SEQ ID NO: 7623 - DNA, 20 bp, Artificial Sequence
  Description of Artificial Sequence: Synthetic oligonucleotide
  Target: ANGPTL3; (-) strand; PAM type: NRG; PAM sequence: TAG
aaacaaataacaaatataaa

SEQ ID NO: 7624 - DNA, 20 bp, Artificial Sequence
  Description of Artificial Sequence: Synthetic oligonucleotide
  Target: ANGPTL3; (-) strand; PAM type: NRG; PAM sequence: TGG
attttaaaaattatttttat

SEQ ID NO: 7625 - DNA, 20 bp, Artificial Sequence
  Description of Artificial Sequence: Synthetic oligonucleotide
  Target: ANGPTL3; (-) strand; PAM type: NRG; PAM sequence: TGG
tcattttaaatttaaaagca

SEQ ID NO: 7626 - DNA, 20 bp, Artificial Sequence
  Description of Artificial Sequence: Synthetic oligonucleotide
  Target: ANGPTL3; (-) strand; PAM type: NRG; PAM sequence: AAG
aaaaatcattttaaatttaa

SEQ ID NO: 7627 - DNA, 20 bp, Artificial Sequence
  Description of Artificial Sequence: Synthetic oligonucleotide
  Target: ANGPTL3; (-) strand; PAM type: NRG; PAM sequence: AGG
ctttctttgtagaaaaagac

SEQ ID NO: 7628 - DNA, 20 bp, Artificial Sequence
  Description of Artificial Sequence: Synthetic oligonucleotide
  Target: ANGPTL3; (-) strand; PAM type: NRG; PAM sequence: CAG
gctttctttgtagaaaaaga

SEQ ID NO: 7629 - DNA, 20 bp, Artificial Sequence
  Description of Artificial Sequence: Synthetic oligonucleotide
  Target: ANGPTL3; (-) strand; PAM type: NRG; PAM sequence: AAG
gtatgctttctttgtagaaa

SEQ ID NO: 7630 - DNA, 20 bp, Artificial Sequence
  Description of Artificial Sequence: Synthetic oligonucleotide
  Target: ANGPTL3; (-) strand; PAM type: NRG; PAM sequence: TAG
cttaatgtatgctttctttg

SEQ ID NO: 7631 - DNA, 20 bp, Artificial Sequence
  Description of Artificial Sequence: Synthetic oligonucleotide
  Target: ANGPTL3; (-) strand; PAM type: NRG; PAM sequence: TGG
tcaaatgtaaacctggcctt

SEQ ID NO: 7632 - DNA, 20 bp, Artificial Sequence
  Description of Artificial Sequence: Synthetic oligonucleotide
  Target: ANGPTL3; (-) strand; PAM type: NRG; PAM sequence: TGG
actttcttcaaatgtaaacc

SEQ ID NO: 7633 - DNA, 20 bp, Artificial Sequence
  Description of Artificial Sequence: Synthetic oligonucleotide
  Target: ANGPTL3; (-) strand; PAM type: NRG; PAM sequence: GAG
ttaagtattcctagagactt

SEQ ID NO: 7634 - DNA, 20 bp, Artificial Sequence
  Description of Artificial Sequence: Synthetic oligonucleotide
  Target: ANGPTL3; (-) strand; PAM type: NRG; PAM sequence: GAG
agatgtgttaagtattccta

SEQ ID NO: 7635 - DNA, 20 bp, Artificial Sequence
  Description of Artificial Sequence: Synthetic oligonucleotide
  Target: ANGPTL3; (-) strand; PAM type: NRG; PAM sequence: TAG
agagatgtgttaagtattcc

SEQ ID NO: 7636 - DNA, 20 bp, Artificial Sequence
  Description of Artificial Sequence: Synthetic oligonucleotide
  Target: ANGPTL3; (-) strand; PAM type: NRG; PAM sequence: AAG
atacagtcaagagatgtgtt

SEQ ID NO: 7637 - DNA, 20 bp, Artificial Sequence
  Description of Artificial Sequence: Synthetic oligonucleotide
  Target: ANGPTL3; (-) strand; PAM type: NRG; PAM sequence: GAG
taacatccatatacagtcaa

SEQ ID NO: 7638 - DNA, 20 bp, Artificial Sequence
  Description of Artificial Sequence: Synthetic oligonucleotide
  Target: ANGPTL3; (-) strand; PAM type: NRG; PAM sequence: AAG
attaacatccatatacagtc

SEQ ID NO: 7639 - DNA, 20 bp, Artificial Sequence
  Description of Artificial Sequence: Synthetic oligonucleotide
  Target: ANGPTL3; (-) strand; PAM type: NRG; PAM sequence: CAG
tatttattaacatccatata

SEQ ID NO: 7640 - DNA, 20 bp, Artificial Sequence
  Description of Artificial Sequence: Synthetic oligonucleotide
  Target: ANGPTL3; (-) strand; PAM type: NRG; PAM sequence: CAG
atatggataaactttactgt

SEQ ID NO: 7641 - DNA, 20 bp, Artificial Sequence
  Description of Artificial Sequence: Synthetic oligonucleotide
  Target: ANGPTL3; (-) strand; PAM type: NRG; PAM sequence: TGG
aatatttgcaagtctttata

SEQ ID NO: 7642 - DNA, 20 bp, Artificial Sequence
  Description of Artificial Sequence: Synthetic oligonucleotide
  Target: ANGPTL3; (-) strand; PAM type: NRG; PAM sequence: AAG
attggtagaggaatatttgc

SEQ ID NO: 7643 - DNA, 20 bp, Artificial Sequence
  Description of Artificial Sequence: Synthetic oligonucleotide
  Target: ANGPTL3; (-) strand; PAM type: NRG; PAM sequence: AGG
taaagtctcgtcattggtag

SEQ ID NO: 7644 - DNA, 20 bp, Artificial Sequence
  Description of Artificial Sequence: Synthetic oligonucleotide
  Target: ANGPTL3; (-) strand; PAM type: NRG; PAM sequence: GAG
ttaaagtctcgtcattggta

SEQ ID NO: 7645 - DNA, 20 bp, Artificial Sequence
  Description of Artificial Sequence: Synthetic oligonucleotide
  Target: ANGPTL3; (-) strand; PAM type: NRG; PAM sequence: TAG
ttttaaagtctcgtcattgg

SEQ ID NO: 7646 - DNA, 20 bp, Artificial Sequence
  Description of Artificial Sequence: Synthetic oligonucleotide
  Target: ANGPTL3; (-) strand; PAM type: NRG; PAM sequence: TGG
atattttaaagtctcgtcat

SEQ ID NO: 7647 - DNA, 20 bp, Artificial Sequence
  Description of Artificial Sequence: Synthetic oligonucleotide
  Target: ANGPTL3; (-) strand; PAM type: NRG; PAM sequence: AAG
acattattatagatatttta

SEQ ID NO: 7648 - DNA, 20 bp, Artificial Sequence
  Description of Artificial Sequence: Synthetic oligonucleotide
  Target: ANGPTL3; (-) strand; PAM type: NRG; PAM sequence: TAG
tgaaatgtgttacattatta

SEQ ID NO: 7649 - DNA, 20 bp, Artificial Sequence
  Description of Artificial Sequence: Synthetic oligonucleotide
  Target: ANGPTL3; (-) strand; PAM type: NRG; PAM sequence: CAG
tatgacaagacatgtttcac

SEQ ID NO: 7650 - DNA, 20 bp, Artificial Sequence
  Description of Artificial Sequence: Synthetic oligonucleotide
  Target: ANGPTL3; (-) strand; PAM type: NRG; PAM sequence: AAG
ctttctataatgcatatgac

SEQ ID NO: 7651 - DNA, 20 bp, Artificial Sequence
  Description of Artificial Sequence: Synthetic oligonucleotide
  Target: ANGPTL3; (-) strand; PAM type: NRG; PAM sequence: AAG
aaaaatattaatataactga

SEQ ID NO: 7652 - DNA, 20 bp, Artificial Sequence
  Description of Artificial Sequence: Synthetic oligonucleotide
  Target: ANGPTL3; (-) strand; PAM type: NRG; PAM sequence: TAG
taaaacaattttattgaaga

SEQ ID NO: 7653 - DNA, 20 bp, Artificial Sequence
  Description of Artificial Sequence: Synthetic oligonucleotide
  Target: ANGPTL3; (-) strand; PAM type: NRG; PAM sequence: AAG
cttttaaaacaattttattg

SEQ ID NO: 7654 - DNA, 20 bp, Artificial Sequence
  Description of Artificial Sequence: Synthetic oligonucleotide
  Target: ANGPTL3; (-) strand; PAM type: NRG; PAM sequence: TAG
cttgaatcccttgatcattt

SEQ ID NO: 7655 - DNA, 20 bp, Artificial Sequence
  Description of Artificial Sequence: Synthetic oligonucleotide
  Target: ANGPTL3; (-) strand; PAM type: NRG; PAM sequence: TAG
gtgcaactaattgagttgtt

SEQ ID NO: 7656 - DNA, 20 bp, Artificial Sequence
  Description of Artificial Sequence: Synthetic oligonucleotide
  Target: ANGPTL3; (-) strand; PAM type: NRG; PAM sequence: GAG
ttttattggtgcaactaatt

SEQ ID NO: 7657 - DNA, 20 bp, Artificial Sequence
  Description of Artificial Sequence: Synthetic oligonucleotide
  Target: ANGPTL3; (-) strand; PAM type: NRG; PAM sequence: TGG
tttttttaagtgttttttat

SEQ ID NO: 7658 - DNA, 20 bp, Artificial Sequence
  Description of Artificial Sequence: Synthetic oligonucleotide
  Target: ANGPTL3; (-) strand; PAM type: NRG; PAM sequence: AAG
tggacactgacagttttttt

SEQ ID NO: 7659 - DNA, 20 bp, Artificial Sequence
  Description of Artificial Sequence: Synthetic oligonucleotide
  Target: ANGPTL3; (-) strand; PAM type: NRG; PAM sequence: CAG
aagtacaggttggacactga

SEQ ID NO: 7660 - DNA, 20 bp, Artificial Sequence
  Description of Artificial Sequence: Synthetic oligonucleotide
  Target: ANGPTL3; (-) strand; PAM type: NRG; PAM sequence: TGG
gtgagttattaagtacaggt

SEQ ID NO: 7661 - DNA, 20 bp, Artificial Sequence
  Description of Artificial Sequence: Synthetic oligonucleotide
  Target: ANGPTL3; (-) strand; PAM type: NRG; PAM sequence: AGG
atctgtgagttattaagtac

SEQ ID NO: 7662 - DNA, 20 bp, Artificial Sequence
  Description of Artificial Sequence: Synthetic oligonucleotide
  Target: ANGPTL3; (-) strand; PAM type: NRG; PAM sequence: CAG
aatctgtgagttattaagta

SEQ ID NO: 7663 - DNA, 20 bp, Artificial Sequence
  Description of Artificial Sequence: Synthetic oligonucleotide
  Target: ANGPTL3; (-) strand; PAM type: NRG; PAM sequence: AAG
ttaaaaatctgtgagttatt

SEQ ID NO: 7664 - DNA, 20 bp, Artificial Sequence
  Description of Artificial Sequence: Synthetic oligonucleotide
  Target: ANGPTL3; (-) strand; PAM type: NRG; PAM sequence: GAG
gaaaagttttaaaaatctgt

SEQ ID NO: 7665 - DNA, 20 bp, Artificial Sequence
  Description of Artificial Sequence: Synthetic oligonucleotide
  Target: ANGPTL3; (-) strand; PAM type: NRG; PAM sequence: AAG
caaaattctcctgaaaagaa

SEQ ID NO: 7666 - DNA, 20 bp, Artificial Sequence
  Description of Artificial Sequence: Synthetic oligonucleotide
  Target: ANGPTL3; (-) strand; PAM type: NRG; PAM sequence: AAG
ccaaccaaaattctcctgaa

SEQ ID NO: 7667 - DNA, 20 bp, Artificial Sequence
  Description of Artificial Sequence: Synthetic oligonucleotide
  Target: ANGPTL3; (-) strand; PAM type: NRG; PAM sequence: AGG
ctatggagtatatcttctct

SEQ ID NO: 7668 - DNA, 20 bp, Artificial Sequence
  Description of Artificial Sequence: Synthetic oligonucleotide
  Target: ANGPTL3; (-) strand; PAM type: NRG; PAM sequence: TAG
actatggagtatatcttctc

SEQ ID NO: 7669 - DNA, 20 bp, Artificial Sequence
  Description of Artificial Sequence: Synthetic oligonucleotide
  Target: ANGPTL3; (-) strand; PAM type: NRG; PAM sequence: GAG
aattagattgcttcactatg

SEQ ID NO: 7670 - DNA, 20 bp, Artificial Sequence
  Description of Artificial Sequence: Synthetic oligonucleotide
  Target: ANGPTL3; (-) strand; PAM type: NRG; PAM sequence: TGG
ataattagattgcttcacta

SEQ ID NO: 7671 - DNA, 20 bp, Artificial Sequence
  Description of Artificial Sequence: Synthetic oligonucleotide
  Target: ANGPTL3; (-) strand; PAM type: NRG; PAM sequence: TAG
ctcaattcgtaaaacataat

SEQ ID NO: 7672 - DNA, 20 bp, Artificial Sequence
  Description of Artificial Sequence: Synthetic oligonucleotide
  Target: ANGPTL3; (-) strand; PAM type: NRG; PAM sequence: CAG
tataatgtttgttgtctttc

SEQ ID NO: 7673 - DNA, 20 bp, Artificial Sequence
  Description of Artificial Sequence: Synthetic oligonucleotide
  Target: ANGPTL3; (-) strand; PAM type: NRG; PAM sequence: AAG
ttcgtgatttcccaagtaaa

SEQ ID NO: 7674 - DNA, 20 bp, Artificial Sequence
  Description of Artificial Sequence: Synthetic oligonucleotide
  Target: ANGPTL3; (-) strand; PAM type: NRG; PAM sequence: AAG
agttggtttcgtgatttccc

SEQ ID NO: 7675 - DNA, 20 bp, Artificial Sequence
  Description of Artificial Sequence: Synthetic oligonucleotide
  Target: ANGPTL3; (-) strand; PAM type: NRG; PAM sequence: TGG
aactagatgtagcgtatagt

SEQ ID NO: 7676 - DNA, 20 bp, Artificial Sequence
  Description of Artificial Sequence: Synthetic oligonucleotide
  Target: ANGPTL3; (-) strand; PAM type: NRG; PAM sequence: TAG
tcgcaactagatgtagcgta

SEQ ID NO: 7677 - DNA, 20 bp, Artificial Sequence
  Description of Artificial Sequence: Synthetic oligonucleotide
  Target: ANGPTL3; (-) strand; PAM type: NRG; PAM sequence: TAG
ccagtaatcgcaactagatg

SEQ ID NO: 7678 - DNA, 20 bp, Artificial Sequence
  Description of Artificial Sequence: Synthetic oligonucleotide
  Target: ANGPTL3; (-) strand; PAM type: NRG; PAM sequence: TAG
acattgccagtaatcgcaac

SEQ ID NO: 7679 - DNA, 20 bp, Artificial Sequence
  Description of Artificial Sequence: Synthetic oligonucleotide
  Target: ANGPTL3; (-) strand; PAM type: NRG; PAM sequence: CAG
gattgcattggggacattgc

SEQ ID NO: 7680 - DNA, 20 bp, Artificial Sequence
  Description of Artificial Sequence: Synthetic oligonucleotide
  Target: ANGPTL3; (-) strand; PAM type: NRG; PAM sequence: GGG
tgttttccgggattgcattg

SEQ ID NO: 7681 - DNA, 20 bp, Artificial Sequence
  Description of Artificial Sequence: Synthetic oligonucleotide
  Target: ANGPTL3; (-) strand; PAM type: NRG; PAM sequence: GGG
ttgttttccgggattgcatt

SEQ ID NO: 7682 - DNA, 20 bp, Artificial Sequence
  Description of Artificial Sequence: Synthetic oligonucleotide
  Target: ANGPTL3; (-) strand; PAM type: NRG; PAM sequence: TGG
tttgttttccgggattgcat

SEQ ID NO: 7683 - DNA, 20 bp, Artificial Sequence
  Description of Artificial Sequence: Synthetic oligonucleotide
  Target: ANGPTL3; (-) strand; PAM type: NRG; PAM sequence: GGG
acaccaaatctttgttttcc

SEQ ID NO: 7684 - DNA, 20 bp, Artificial Sequence
  Description of Artificial Sequence: Synthetic oligonucleotide
  Target: ANGPTL3; (-) strand; PAM type: NRG; PAM sequence: CGG
aacaccaaatctttgttttc

SEQ ID NO: 7685 - DNA, 20 bp, Artificial Sequence
  Description of Artificial Sequence: Synthetic oligonucleotide
  Target: ANGPTL3; (-) strand; PAM type: NRG; PAM sequence: TAG
ttttgctttgtgatcccaag

SEQ ID NO: 7686 - DNA, 20 bp, Artificial Sequence
  Description of Artificial Sequence: Synthetic oligonucleotide
  Target: ANGPTL3; (-) strand; PAM type: NRG; PAM sequence: AAG
tccttttgctttgtgatccc

SEQ ID NO: 7687 - DNA, 20 bp, Artificial Sequence
  Description of Artificial Sequence: Synthetic oligonucleotide
  Target: ANGPTL3; (-) strand; PAM type: NRG; PAM sequence: AAG
aataaccctctggacagttg

SEQ ID NO: 7688 - DNA, 20 bp, Artificial Sequence
  Description of Artificial Sequence: Synthetic oligonucleotide
  Target: ANGPTL3; (-) strand; PAM type: NRG; PAM sequence: CAG
tacctgaataaccctctgga

SEQ ID NO: 7689 - DNA, 20 bp, Artificial Sequence
  Description of Artificial Sequence: Synthetic oligonucleotide
  Target: ANGPTL3; (-) strand; PAM type: NRG; PAM sequence: TGG
aagatacctgaataaccctc

SEQ ID NO: 7690 - DNA, 20 bp, Artificial Sequence
  Description of Artificial Sequence: Synthetic oligonucleotide
  Target: ANGPTL3; (-) strand; PAM type: NRG; PAM sequence: AAG
taaagtattggtatcagaaa

SEQ ID NO: 7691 - DNA, 20 bp, Artificial Sequence
  Description of Artificial Sequence: Synthetic oligonucleotide
  Target: ANGPTL3; (-) strand; PAM type: NRG; PAM sequence: CAG
tgaaaataaagtattggtat

SEQ ID NO: 7692 - DNA, 20 bp, Artificial Sequence
  Description of Artificial Sequence: Synthetic oligonucleotide
  Target: ANGPTL3; (-) strand; PAM type: NRG; PAM sequence: TGG
aagatatgaaaataaagtat

SEQ ID NO: 7693 - DNA, 20 bp, Artificial Sequence
  Description of Artificial Sequence: Synthetic oligonucleotide
  Target: ANGPTL3; (-) strand; PAM type: NRG; PAM sequence: AAG
actttgaagatatgaaaata

SEQ ID NO: 7694 - DNA, 20 bp, Artificial Sequence
  Description of Artificial Sequence: Synthetic oligonucleotide
  Target: ANGPTL3; (-) strand; PAM type: NRG; PAM sequence: AAG
taatgtgggaagatactttg

SEQ ID NO: 7695 - DNA, 20 bp, Artificial Sequence
  Description of Artificial Sequence: Synthetic oligonucleotide
  Target: ANGPTL3; (-) strand; PAM type: NRG; PAM sequence: AAG
ataatagctaataatgtggg

SEQ ID NO: 7696 - DNA, 20 bp, Artificial Sequence
  Description of Artificial Sequence: Synthetic oligonucleotide
  Target: ANGPTL3; (-) strand; PAM type: NRG; PAM sequence: GGG
cagataatagctaataatgt

SEQ ID NO: 7697 - DNA, 20 bp, Artificial Sequence
  Description of Artificial Sequence: Synthetic oligonucleotide
  Target: ANGPTL3; (-) strand; PAM type: NRG; PAM sequence: TGG
gcagataatagctaataatg

SEQ ID NO: 7698 - DNA, 20 bp, Artificial Sequence
  Description of Artificial Sequence: Synthetic oligonucleotide
  Target: ANGPTL3; (-) strand; PAM type: NRG; PAM sequence: TAG
aaagttgtcattgcagataa

SEQ ID NO: 7699 - DNA, 20 bp, Artificial Sequence
  Description of Artificial Sequence: Synthetic oligonucleotide
  Target: ANGPTL3; (-) strand; PAM type: NRG; PAM sequence: CAG
atttttaaaagttgtcattg

SEQ ID NO: 7700 - DNA, 20 bp, Artificial Sequence
  Description of Artificial Sequence: Synthetic oligonucleotide
  Target: ANGPTL3; (-) strand; PAM type: NRG; PAM sequence: AAG
tttgggattcggatttttaa

SEQ ID NO: 7701 - DNA, 20 bp, Artificial Sequence
  Description of Artificial Sequence: Synthetic oligonucleotide
  Target: ANGPTL3; (-) strand; PAM type: NRG; PAM sequence: CGG
gaaaacgcttatttgggatt

SEQ ID NO: 7702 - DNA, 20 bp, Artificial Sequence
  Description of Artificial Sequence: Synthetic oligonucleotide
  Target: ANGPTL3; (-) strand; PAM type: NRG; PAM sequence: GGG
tagagagaaaacgcttattt

SEQ ID NO: 7703 - DNA, 20 bp, Artificial Sequence
  Description of Artificial Sequence: Synthetic oligonucleotide
  Target: ANGPTL3; (-) strand; PAM type: NRG; PAM sequence: TGG
ctagagagaaaacgcttatt

SEQ ID NO: 7704 - DNA, 20 bp, Artificial Sequence
  Description of Artificial Sequence: Synthetic oligonucleotide
  Target: ANGPTL3; (-) strand; PAM type: NRG; PAM sequence: GAG
ttaagaggttttcgtctaga

SEQ ID NO: 7705 - DNA, 20 bp, Artificial Sequence
  Description of Artificial Sequence: Synthetic oligonucleotide
  Target: ANGPTL3; (-) strand; PAM type: NRG; PAM sequence: GAG
agttaagaggttttcgtcta

SEQ ID NO: 7706 - DNA, 20 bp, Artificial Sequence
  Description of Artificial Sequence: Synthetic oligonucleotide
  Target: ANGPTL3; (-) strand; PAM type: NRG; PAM sequence: TAG
atagttaagaggttttcgtc

SEQ ID NO: 7707 - DNA, 20 bp, Artificial Sequence
  Description of Artificial Sequence: Synthetic oligonucleotide
  Target: ANGPTL3; (-) strand; PAM type: NRG; PAM sequence: AGG
acactttcattatagttaag

SEQ ID NO: 7708 - DNA, 20 bp, Artificial Sequence
  Description of Artificial Sequence: Synthetic oligonucleotide
  Target: ANGPTL3; (-) strand; PAM type: NRG; PAM sequence: GAG
aacactttcattatagttaa

SEQ ID NO: 7709 - DNA, 20 bp, Artificial Sequence
  Description of Artificial Sequence: Synthetic oligonucleotide
  Target: ANGPTL3; (-) strand; PAM type: NRG; PAM sequence: AAG
tgaacactttcattatagtt

SEQ ID NO: 7710 - DNA, 20 bp, Artificial Sequence
  Description of Artificial Sequence: Synthetic oligonucleotide
  Target: ANGPTL3; (-) strand; PAM type: NRG; PAM sequence: TAG
tagaatgaacactttcatta

SEQ ID NO: 7711 - DNA, 20 bp, Artificial Sequence
  Description of Artificial Sequence: Synthetic oligonucleotide
  Target: ANGPTL3; (-) strand; PAM type: NRG; PAM sequence: TAG
ggtaaaatacctgattgaac

SEQ ID NO: 7712 - DNA, 20 bp, Artificial Sequence
  Description of Artificial Sequence: Synthetic oligonucleotide
  Target: ANGPTL3; (-) strand; PAM type: NRG; PAM sequence: AGG
gaaaatctgaggaagattag

SEQ ID NO: 7713 - DNA, 20 bp, Artificial Sequence
  Description of Artificial Sequence: Synthetic oligonucleotide
  Target: ANGPTL3; (-) strand; PAM type: NRG; PAM sequence: GAG
agaaaatctgaggaagatta

SEQ ID NO: 7714 - DNA, 20 bp, Artificial Sequence
  Description of Artificial Sequence: Synthetic oligonucleotide
  Target: ANGPTL3; (-) strand; PAM type: NRG; PAM sequence: TAG
atagaaaatctgaggaagat

SEQ ID NO: 7715 - DNA, 20 bp, Artificial Sequence
  Description of Artificial Sequence: Synthetic oligonucleotide
  Target: ANGPTL3; (-) strand; PAM type: NRG; PAM sequence: AAG
aaaaaatagaaaatctgagg

SEQ ID NO: 7716 - DNA, 20 bp, Artificial Sequence
  Description of Artificial Sequence: Synthetic oligonucleotide
  Target: ANGPTL3; (-) strand; PAM type: NRG; PAM sequence: AGG
accaaaaaatagaaaatctg

SEQ ID NO: 7717 - DNA, 20 bp, Artificial Sequence
  Description of Artificial Sequence: Synthetic oligonucleotide
  Target: ANGPTL3; (-) strand; PAM type: NRG; PAM sequence: GAG
taccaaaaaatagaaaatct

SEQ ID NO: 7718 - DNA, 20 bp, Artificial Sequence
  Description of Artificial Sequence: Synthetic oligonucleotide
  Target: ANGPTL3; (-) strand; PAM type: NRG; PAM sequence: TAG
atctatacactaccaaaaaa

SEQ ID NO: 7719 - DNA, 20 bp, Artificial Sequence
  Description of Artificial Sequence: Synthetic oligonucleotide
  Target: ANGPTL3; (-) strand; PAM type: NRG; PAM sequence: AAG
cagttttaaataatctgtat

SEQ ID NO: 7720 - DNA, 20 bp, Artificial Sequence
  Description of Artificial Sequence: Synthetic oligonucleotide
  Target: ANGPTL3; (-) strand; PAM type: NRG; PAM sequence: CAG
tgttttagatgcatgtatcc

SEQ ID NO: 7721 - DNA, 20 bp, Artificial Sequence
  Description of Artificial Sequence: Synthetic oligonucleotide
  Target: ANGPTL3; (-) strand; PAM type: NRG; PAM sequence: TAG
ttataaatattacagtgttt

SEQ ID NO: 7722 - DNA, 20 bp, Artificial Sequence
  Description of Artificial Sequence: Synthetic oligonucleotide
  Target: ANGPTL3; (-) strand; PAM type: NRG; PAM sequence: CAG
ttcctttcttataaatatta

SEQ ID NO: 7723 - DNA, 20 bp, Artificial Sequence
  Description of Artificial Sequence: Synthetic oligonucleotide
  Target: ANGPTL3; (-) strand; PAM type: NRG; PAM sequence: AAG
ctgttactgtatttccccgt

SEQ ID NO: 7724 - DNA, 20 bp, Artificial Sequence
  Description of Artificial Sequence: Synthetic oligonucleotide
  Target: ANGPTL3; (-) strand; PAM type: NRG; PAM sequence: TAG
aatgggtacagactcgtatg

SEQ ID NO: 7725 - DNA, 20 bp, Artificial Sequence
  Description of Artificial Sequence: Synthetic oligonucleotide
  Target: ANGPTL3; (-) strand; PAM type: NRG; PAM sequence: CAG
gatatgcaatttaatgggta

SEQ ID NO: 7726 - DNA, 20 bp, Artificial Sequence
  Description of Artificial Sequence: Synthetic oligonucleotide
  Target: ANGPTL3; (-) strand; PAM type: NRG; PAM sequence: GGG
agatagatatgcaatttaat

SEQ ID NO: 7727 - DNA, 20 bp, Artificial Sequence
  Description of Artificial Sequence: Synthetic oligonucleotide
  Target: ANGPTL3; (-) strand; PAM type: NRG; PAM sequence: TGG
gagatagatatgcaatttaa

SEQ ID NO: 7728 - DNA, 20 bp, Artificial Sequence
  Description of Artificial Sequence: Synthetic oligonucleotide
  Target: ANGPTL3; (-) strand; PAM type: NRG; PAM sequence: TAG
caccagcctcctaaaggaga

SEQ ID NO: 7729 - DNA, 20 bp, Artificial Sequence
  Description of Artificial Sequence: Synthetic oligonucleotide
  Target: ANGPTL3; (-) strand; PAM type: NRG; PAM sequence: GAG
ccaccaccagcctcctaaag

SEQ ID NO: 7730 - DNA, 20 bp, Artificial Sequence
  Description of Artificial Sequence: Synthetic oligonucleotide
  Target: ANGPTL3; (-) strand; PAM type: NRG; PAM sequence: AGG
tgccaccaccagcctcctaa

SEQ ID NO: 7731 - DNA, 20 bp, Artificial Sequence
  Description of Artificial Sequence: Synthetic oligonucleotide
  Target: ANGPTL3; (-) strand; PAM type: NRG; PAM sequence: AAG
atgccaccaccagcctccta

SEQ ID NO: 7732 - DNA, 20 bp, Artificial Sequence
  Description of Artificial Sequence: Synthetic oligonucleotide
  Target: ANGPTL3; (-) strand; PAM type: NRG; PAM sequence: CAG
cacactcatcatgccaccac

SEQ ID NO: 7733 - DNA, 20 bp, Artificial Sequence
  Description of Artificial Sequence: Synthetic oligonucleotide
  Target: ANGPTL3; (-) strand; PAM type: NRG; PAM sequence: AGG
gtttgttatatttaccattt

SEQ ID NO: 7734 - DNA, 20 bp, Artificial Sequence
  Description of Artificial Sequence: Synthetic oligonucleotide
  Target: ANGPTL3; (-) strand; PAM type: NRG; PAM sequence: TAG
ggtttgttatatttaccatt

SEQ ID NO: 7735 - DNA, 20 bp, Artificial Sequence
  Description of Artificial Sequence: Synthetic oligonucleotide
  Target: ANGPTL3; (-) strand; PAM type: NRG; PAM sequence: TGG
tctggcttagattttgctct

SEQ ID NO: 7736 - DNA, 20 bp, Artificial Sequence
  Description of Artificial Sequence: Synthetic oligonucleotide
  Target: ANGPTL3; (-) strand; PAM type: NRG; PAM sequence: TAG
tcctcttctcctctctggct

SEQ ID NO: 7737 - DNA, 20 bp, Artificial Sequence
  Description of Artificial Sequence: Synthetic oligonucleotide
  Target: ANGPTL3; (-) strand; PAM type: NRG; PAM sequence: TGG
gataatcctcttctcctctc

SEQ ID NO: 7738 - DNA, 20 bp, Artificial Sequence
  Description of Artificial Sequence: Synthetic oligonucleotide
  Target: ANGPTL3; (-) strand; PAM type: NRG; PAM sequence: AAG
ccttccattttgagacttcc

SEQ ID NO: 7739 - DNA, 20 bp, Artificial Sequence
  Description of Artificial Sequence: Synthetic oligonucleotide
  Target: ANGPTL3; (-) strand; PAM type: NRG; PAM sequence: GAG
agagtataaccttccatttt

SEQ ID NO: 7740 - DNA, 20 bp, Artificial Sequence
  Description of Artificial Sequence: Synthetic oligonucleotide
  Target: ANGPTL3; (-) strand; PAM type: NRG; PAM sequence: GAG
acattttggttgattttata

SEQ ID NO: 7741 - DNA, 20 bp, Artificial Sequence
  Description of Artificial Sequence: Synthetic oligonucleotide
  Target: ANGPTL3; (-) strand; PAM type: NRG; PAM sequence: TAG
caacattttggttgatttta

SEQ ID NO: 7742 - DNA, 20 bp, Artificial Sequence
  Description of Artificial Sequence: Synthetic oligonucleotide
  Target: ANGPTL3; (-) strand; PAM type: NRG; PAM sequence: TGG
tgttggatggatcaacattt

SEQ ID NO: 7743 - DNA, 20 bp, Artificial Sequence
  Description of Artificial Sequence: Synthetic oligonucleotide
  Target: ANGPTL3; (-) strand; PAM type: NRG; PAM sequence: TGG
agctttctgaatctgttgga

SEQ ID NO: 7744 - DNA, 20 bp, Artificial Sequence
  Description of Artificial Sequence: Synthetic oligonucleotide
  Target: ANGPTL3; (-) strand; PAM type: NRG; PAM sequence: TGG
tcaaagctttctgaatctgt

SEQ ID NO: 7745 - DNA, 20 bp, Artificial Sequence
  Description of Artificial Sequence: Synthetic oligonucleotide
  Target: ANGPTL3; (-) strand; PAM type: NRG; PAM sequence: AAG
aatttgcctcagttcattca

SEQ ID NO: 7746 - DNA, 20 bp, Artificial Sequence
  Description of Artificial Sequence: Synthetic oligonucleotide
  Target: ANGPTL3; (-) strand; PAM type: NRG; PAM sequence: CAG
attgccttttaaatttgcct

SEQ ID NO: 7747 - DNA, 20 bp, Artificial Sequence
  Description of Artificial Sequence: Synthetic oligonucleotide
  Target: ANGPTL3; (-) strand; PAM type: NRG; PAM sequence: AGG
gaccacattaacttggaatg

SEQ ID NO: 7748 - DNA, 20 bp, Artificial Sequence
  Description of Artificial Sequence: Synthetic oligonucleotide
  Target: ANGPTL3; (-) strand; PAM type: NRG; PAM sequence: GAG
agaccacattaacttggaat

SEQ ID NO: 7749 - DNA, 20 bp, Artificial Sequence
  Description of Artificial Sequence: Synthetic oligonucleotide
  Target: ANGPTL3; (-) strand; PAM type: NRG; PAM sequence: TGG
attattagaccacattaact

SEQ ID NO: 7750 - DNA, 20 bp, Artificial Sequence
  Description of Artificial Sequence: Synthetic oligonucleotide
  Target: ANGPTL3; (-) strand; PAM type: NRG; PAM sequence: TAG
aggatttaataccagattat

SEQ ID NO: 7751 - DNA, 20 bp, Artificial Sequence
  Description of Artificial Sequence: Synthetic oligonucleotide
  Target: ANGPTL3; (-) strand; PAM type: NRG; PAM sequence: CAG
ttctcttaaggatttaatac

SEQ ID NO: 7752 - DNA, 20 bp, Artificial Sequence
  Description of Artificial Sequence: Synthetic oligonucleotide
  Target: ANGPTL3; (-) strand; PAM type: NRG; PAM sequence: AGG
atttctcaagctttctctta

SEQ ID NO: 7753 - DNA, 20 bp, Artificial Sequence
  Description of Artificial Sequence: Synthetic oligonucleotide
  Target: ANGPTL3; (-) strand; PAM type: NRG; PAM sequence: AAG
tatttctcaagctttctctt

SEQ ID NO: 7754 - DNA, 20 bp, Artificial Sequence
  Description of Artificial Sequence: Synthetic oligonucleotide
  Target: ANGPTL3; (-) strand; PAM type: NRG; PAM sequence: AAG
ataaaaaaaatctatttctc

SEQ ID NO: 7755 - DNA, 20 bp, Artificial Sequence
  Description of Artificial Sequence: Synthetic oligonucleotide
  Target: ANGPTL3; (-) strand; PAM type: NRG; PAM sequence: AAG
cttaaatagacagtgacttt

SEQ ID NO: 7756 - DNA, 20 bp, Artificial Sequence
  Description of Artificial Sequence: Synthetic oligonucleotide
  Target: ANGPTL3; (-) strand; PAM type: NRG; PAM sequence: CAG
tatgtttaatcttaaataga

SEQ ID NO: 7757 - DNA, 20 bp, Artificial Sequence
  Description of Artificial Sequence: Synthetic oligonucleotide
  Target: ANGPTL3; (-) strand; PAM type: NRG; PAM sequence: TAG
attgtatgtttaatcttaaa

SEQ ID NO: 7758 - DNA, 20 bp, Artificial Sequence
  Description of Artificial Sequence: Synthetic oligonucleotide
  Target: ANGPTL3; (-) strand; PAM type: NRG; PAM sequence: AGG
aatgtaaacggtattcttta

SEQ ID NO: 7759 - DNA, 20 bp, Artificial Sequence
  Description of Artificial Sequence: Synthetic oligonucleotide
  Target: ANGPTL3; (-) strand; PAM type: NRG; PAM sequence: AAG
aaatgtaaacggtattcttt

SEQ ID NO: 7760 - DNA, 20 bp, Artificial Sequence
  Description of Artificial Sequence: Synthetic oligonucleotide
  Target: ANGPTL3; (-) strand; PAM type: NRG; PAM sequence: CGG
ttttgattgagaaatgtaaa

SEQ ID NO: 7761 - DNA, 20 bp, Artificial Sequence
  Description of Artificial Sequence: Synthetic oligonucleotide
  Target: ANGPTL3; (-) strand; PAM type: NRG; PAM sequence: GAG
gtattataagaattttgatt

SEQ ID NO: 7762 - DNA, 20 bp, Artificial Sequence
  Description of Artificial Sequence: Synthetic oligonucleotide
  Target: ANGPTL3; (-) strand; PAM type: NRG; PAM sequence: AAG
tttaaaacaaatagtattat

SEQ ID NO: 7763 - DNA, 20 bp, Artificial Sequence
  Description of Artificial Sequence: Synthetic oligonucleotide
  Target: ANGPTL3; (-) strand; PAM type: NRG; PAM sequence: TAG
atcacaaaatttaaaacaaa

SEQ ID NO: 7764 - DNA, 20 bp, Artificial Sequence
  Description of Artificial Sequence: Synthetic oligonucleotide
  Target: ANGPTL3; (-) strand; PAM type: NRG; PAM sequence: TAG
ttcacctattgattataatc

SEQ ID NO: 7765 - DNA, 20 bp, Artificial Sequence
  Description of Artificial Sequence: Synthetic oligonucleotide
  Target: ANGPTL3; (-) strand; PAM type: NRG; PAM sequence: AAG
atttagaaaagttatttaat

SEQ ID NO: 7766 - DNA, 20 bp, Artificial Sequence
  Description of Artificial Sequence: Synthetic oligonucleotide
  Target: ANGPTL3; (-) strand; PAM type: NRG; PAM sequence: AAG
tctaaattttttatttagaa

SEQ ID NO: 7767 - DNA, 20 bp, Artificial Sequence
  Description of Artificial Sequence: Synthetic oligonucleotide
  Target: ANGPTL3; (-) strand; PAM type: NRG; PAM sequence: TAG
aagtctctaaattttttatt

SEQ ID NO: 7768 - DNA, 20 bp, Artificial Sequence
  Description of Artificial Sequence: Synthetic oligonucleotide
  Target: ANGPTL3; (-) strand; PAM type: NRG; PAM sequence: AAG
tatgatgccttttaaaataa

SEQ ID NO: 7769 - DNA, 20 bp, Artificial Sequence
  Description of Artificial Sequence: Synthetic oligonucleotide
  Target: ANGPTL3; (-) strand; PAM type: NRG; PAM sequence: TAG
aactgggaaagttgtgatat

SEQ ID NO: 7770 - DNA, 20 bp, Artificial Sequence
  Description of Artificial Sequence: Synthetic oligonucleotide
  Target: ANGPTL3; (-) strand; PAM type: NRG; PAM sequence: AAG
actagttttttaaactggga

SEQ ID NO: 7771 - DNA, 20 bp, Artificial Sequence
  Description of Artificial Sequence: Synthetic oligonucleotide
  Target: ANGPTL3; (-) strand; PAM type: NRG; PAM sequence: GGG
gagtactagttttttaaact

SEQ ID NO: 7772 - DNA, 20 bp, Artificial Sequence
  Description of Artificial Sequence: Synthetic oligonucleotide
  Target: ANGPTL3; (-) strand; PAM type: NRG; PAM sequence: TGG
agagtactagttttttaaac

SEQ ID NO: 7773 - DNA, 20 bp, Artificial Sequence
  Description of Artificial Sequence: Synthetic oligonucleotide
  Target: ANGPTL3; (-) strand; PAM type: NRG; PAM sequence: TAG
tagagttttaacaagagtac

SEQ ID NO: 7774 - DNA, 20 bp, Artificial Sequence
  Description of Artificial Sequence: Synthetic oligonucleotide
  Target: ANGPTL3; (-) strand; PAM type: NRG; PAM sequence: GAG
caagtttagagttttaacaa

SEQ ID NO: 7775 - DNA, 20 bp, Artificial Sequence
  Description of Artificial Sequence: Synthetic oligonucleotide
  Target: ANGPTL3; (-) strand; PAM type: NRG; PAM sequence: AAG
gtcaagtttagagttttaac

SEQ ID NO: 7776 - DNA, 20 bp, Artificial Sequence
  Description of Artificial Sequence: Synthetic oligonucleotide
  Target: ANGPTL3; (-) strand; PAM type: NRG; PAM sequence: GAG
tctgtatttagtcaagttta

SEQ ID NO: 7777 - DNA, 20 bp, Artificial Sequence
  Description of Artificial Sequence: Synthetic oligonucleotide
  Target: ANGPTL3; (-) strand; PAM type: NRG; PAM sequence: TAG
cctctgtatttagtcaagtt

SEQ ID NO: 7778 - DNA, 20 bp, Artificial Sequence
  Description of Artificial Sequence: Synthetic oligonucleotide
  Target: ANGPTL3; (-) strand; PAM type: NRG; PAM sequence: AAG
ccagtcctctgtatttagtc

SEQ ID NO: 7779 - DNA, 20 bp, Artificial Sequence
  Description of Artificial Sequence: Synthetic oligonucleotide
  Target: ANGPTL3; (-) strand; PAM type: NRG; PAM sequence: TAG
aattaccagtcctctgtatt

SEQ ID NO: 7780 - DNA, 20 bp, Artificial Sequence
  Description of Artificial Sequence: Synthetic oligonucleotide
  Target: ANGPTL3; (-) strand; PAM type: NRG; PAM sequence: CAG
tttaagaactgtacaattac

SEQ ID NO: 7781 - DNA, 20 bp, Artificial Sequence
  Description of Artificial Sequence: Synthetic oligonucleotide
  Target: ANGPTL3; (-) strand; PAM type: NRG; PAM sequence: AAG
aaattaatactacaacattt

SEQ ID NO: 7782 - DNA, 20 bp, Artificial Sequence
  Description of Artificial Sequence: Synthetic oligonucleotide
  Target: ANGPTL3; (-) strand; PAM type: NRG; PAM sequence: TAG
tactctgtgctgacgatttt

SEQ ID NO: 7783 - DNA, 20 bp, Artificial Sequence
  Description of Artificial Sequence: Synthetic oligonucleotide
  Target: ANGPTL3; (-) strand; PAM type: NRG; PAM sequence: CAG
cagtttaaaaatttgtatta

SEQ ID NO: 7784 - DNA, 20 bp, Artificial Sequence
  Description of Artificial Sequence: Synthetic oligonucleotide
  Target: ANGPTL3; (-) strand; PAM type: NRG; PAM sequence: CAG
tttgtagcaaaatgaagcat

SEQ ID NO: 7785 - DNA, 20 bp, Artificial Sequence
  Description of Artificial Sequence: Synthetic oligonucleotide
  Target: ANGPTL3; (-) strand; PAM type: NRG; PAM sequence: AAG
aattattttgtagcaaaatg

SEQ ID NO: 7786 - DNA, 20 bp, Artificial Sequence
  Description of Artificial Sequence: Synthetic oligonucleotide
  Target: ANGPTL3; (-) strand; PAM type: NRG; PAM sequence: TAG
atttactccaaattattttg

SEQ ID NO: 7787 - DNA, 20 bp, Artificial Sequence
  Description of Artificial Sequence: Synthetic oligonucleotide
  Target: ANGPTL3; (-) strand; PAM type: NRG; PAM sequence: AGG
gtatttaattctgcttcatt

SEQ ID NO: 7788 - DNA, 20 bp, Artificial Sequence
  Description of Artificial Sequence: Synthetic oligonucleotide
  Target: ANGPTL3; (-) strand; PAM type: NRG; PAM sequence: TAG
agtatttaattctgcttcat

SEQ ID NO: 7789 - DNA, 20 bp, Artificial Sequence
  Description of Artificial Sequence: Synthetic oligonucleotide
  Target: ANGPTL3; (-) strand; PAM type: NRG; PAM sequence: CAG
acagcgaacttattttaata

SEQ ID NO: 7790 - DNA, 20 bp, Artificial Sequence
  Description of Artificial Sequence: Synthetic oligonucleotide
  Target: ANGPTL3; (-) strand; PAM type: NRG; PAM sequence: CAG
catctccatttgtttaaaga

SEQ ID NO: 7791 - DNA, 20 bp, Artificial Sequence
  Description of Artificial Sequence: Synthetic oligonucleotide
  Target: ANGPTL3; (-) strand; PAM type: NRG; PAM sequence: AAG
tagtcatctccatttgttta

SEQ ID NO: 7792 - DNA, 20 bp, Artificial Sequence
  Description of Artificial Sequence: Synthetic oligonucleotide
  Target: ANGPTL3; (-) strand; PAM type: NRG; PAM sequence: TAG
ttaaagtcaatgtgacttag

SEQ ID NO: 7793 - DNA, 20 bp, Artificial Sequence
  Description of Artificial Sequence: Synthetic oligonucleotide
  Target: ANGPTL3; (-) strand; PAM type: NRG; PAM sequence: TAG
atgttaaagtcaatgtgact

SEQ ID NO: 7794 - DNA, 20 bp, Artificial Sequence
  Description of Artificial Sequence: Synthetic oligonucleotide
  Target: ANGPTL3; (-) strand; PAM type: NRG; PAM sequence: AAG
tatagtgatacctcatgtta

SEQ ID NO: 7795 - DNA, 20 bp, Artificial Sequence
  Description of Artificial Sequence: Synthetic oligonucleotide
  Target: ANGPTL3; (-) strand; PAM type: NRG; PAM sequence: TAG
atattttaacaaataaggta

SEQ ID NO: 7796 - DNA, 20 bp, Artificial Sequence
  Description of Artificial Sequence: Synthetic oligonucleotide
  Target: ANGPTL3; (-) strand; PAM type: NRG; PAM sequence: AGG
agtatatattttaacaaata

SEQ ID NO: 7797 - DNA, 20 bp, Artificial Sequence
  Description of Artificial Sequence: Synthetic oligonucleotide
  Target: ANGPTL3; (-) strand; PAM type: NRG; PAM sequence: AAG
cagtatatattttaacaaat

SEQ ID NO: 7798 - DNA, 20 bp, Artificial Sequence
  Description of Artificial Sequence: Synthetic oligonucleotide
  Target: ANGPTL3; (-) strand; PAM type: NRG; PAM sequence: CAG
taaaatatataaaatgtata

SEQ ID NO: 7799 - DNA, 20 bp, Artificial Sequence
  Description of Artificial Sequence: Synthetic oligonucleotide
  Target: ANGPTL3; (-) strand; PAM type: NRG; PAM sequence: AAG
ttatttgttttcatagtatt

SEQ ID NO: 7800 - DNA, 20 bp, Artificial Sequence
  Description of Artificial Sequence: Synthetic oligonucleotide
  Target: ANGPTL3; (-) strand; PAM type: NRG; PAM sequence: TAG
tttacaattatttgttttca

SEQ ID NO: 7801 - DNA, 20 bp, Artificial Sequence
  Description of Artificial Sequence: Synthetic oligonucleotide
  Target: ANGPTL3; (-) strand; PAM type: NRG; PAM sequence: AAG
cattcttactgtaatctgac

SEQ ID NO: 7802 - DNA, 20 bp, Artificial Sequence
  Description of Artificial Sequence: Synthetic oligonucleotide
  Target: ANGPTL3; (-) strand; PAM type: NRG; PAM sequence: GGG
tagaatcacagcatatttag

SEQ ID NO: 7803 - DNA, 20 bp, Artificial Sequence
  Description of Artificial Sequence: Synthetic oligonucleotide
  Target: ANGPTL3; (-) strand; PAM type: NRG; PAM sequence: GGG
ttagaatcacagcatattta

SEQ ID NO: 7804 - DNA, 20 bp, Artificial Sequence
  Description of Artificial Sequence: Synthetic oligonucleotide
  Target: ANGPTL3; (-) strand; PAM type: NRG; PAM sequence: AGG
attagaatcacagcatattt

SEQ ID NO: 7805 - DNA, 20 bp, Artificial Sequence
  Description of Artificial Sequence: Synthetic oligonucleotide
  Target: ANGPTL3; (-) strand; PAM type: NRG; PAM sequence: TAG
tattagaatcacagcatatt

SEQ ID NO: 7806 - DNA, 20 bp, Artificial Sequence
  Description of Artificial Sequence: Synthetic oligonucleotide
  Target: ANGPTL3; (-) strand; PAM type: NRG; PAM sequence: CAG
acacgaatgtattagaatca

SEQ ID NO: 7807 - DNA, 20 bp, Artificial Sequence
  Description of Artificial Sequence: Synthetic oligonucleotide
  Target: ANGPTL3; (-) strand; PAM type: NRG; PAM sequence: TAG
gaaaacctacacgaatgtat

SEQ ID NO: 7808 - DNA, 20 bp, Artificial Sequence
  Description of Artificial Sequence: Synthetic oligonucleotide
  Target: ANGPTL3; (-) strand; PAM type: NRG; PAM sequence: AGG
acgttcagtaacttgttacg

SEQ ID NO: 7809 - DNA, 20 bp, Artificial Sequence
  Description of Artificial Sequence: Synthetic oligonucleotide
  Target: ANGPTL3; (-) strand; PAM type: NRG; PAM sequence: GAG
aacgttcagtaacttgttac

SEQ ID NO: 7810 - DNA, 20 bp, Artificial Sequence
  Description of Artificial Sequence: Synthetic oligonucleotide
  Target: ANGPTL3; (-) strand; PAM type: NRG; PAM sequence: CAG
tgtcaggctgtttaaacgtt

SEQ ID NO: 7811 - DNA, 20 bp, Artificial Sequence
  Description of Artificial Sequence: Synthetic oligonucleotide
  Target: ANGPTL3; (-) strand; PAM type: NRG; PAM sequence: AGG
aacatatatacatgcttgtc

SEQ ID NO: 7812 - DNA, 20 bp, Artificial Sequence
  Description of Artificial Sequence: Synthetic oligonucleotide
  Target: ANGPTL3; (-) strand; PAM type: NRG; PAM sequence: CAG
aaacatatatacatgcttgt

SEQ ID NO: 7813 - DNA, 20 bp, Artificial Sequence
  Description of Artificial Sequence: Synthetic oligonucleotide
  Target: ANGPTL3; (-) strand; PAM type: NRG; PAM sequence: GGG
atttctataatttagggact

SEQ ID NO: 7814 - DNA, 20 bp, Artificial Sequence
  Description of Artificial Sequence: Synthetic oligonucleotide
  Target: ANGPTL3; (-) strand; PAM type: NRG; PAM sequence: TGG
aatttctataatttagggac

SEQ ID NO: 7815 - DNA, 20 bp, Artificial Sequence
  Description of Artificial Sequence: Synthetic oligonucleotide
  Target: ANGPTL3; (-) strand; PAM type: NRG; PAM sequence: GGG
atttaaatttctataattta

SEQ ID NO: 7816 - DNA, 20 bp, Artificial Sequence
  Description of Artificial Sequence: Synthetic oligonucleotide
  Target: ANGPTL3; (-) strand; PAM type: NRG; PAM sequence: AGG
aatttaaatttctataattt

SEQ ID NO: 7817 - DNA, 20 bp, Artificial Sequence
  Description of Artificial Sequence: Synthetic oligonucleotide
  Target: ANGPTL3; (-) strand; PAM type: NRG; PAM sequence: TAG
taatttaaatttctataatt

SEQ ID NO: 7818 - DNA, 20 bp, Artificial Sequence
  Description of Artificial Sequence: Synthetic oligonucleotide
  Target: ANGPTL3; (-) strand; PAM type: NRG; PAM sequence: AAG
tgtgatgtcgataaacatgc

SEQ ID NO: 7819 - DNA, 20 bp, Artificial Sequence
  Description of Artificial Sequence: Synthetic oligonucleotide
  Target: ANGPTL3; (-) strand; PAM type: NRG; PAM sequence: GGG
tttagggatttagggattta

SEQ ID NO: 7820 - DNA, 20 bp, Artificial Sequence
  Description of Artificial Sequence: Synthetic oligonucleotide
  Target: ANGPTL3; (-) strand; PAM type: NRG; PAM sequence: AGG
ctttagggatttagggattt

SEQ ID NO: 7821 - DNA, 20 bp, Artificial Sequence
  Description of Artificial Sequence: Synthetic oligonucleotide
  Target: ANGPTL3; (-) strand; PAM type: NRG; PAM sequence: TAG
tctttagggatttagggatt

SEQ ID NO: 7822 - DNA, 20 bp, Artificial Sequence
  Description of Artificial Sequence: Synthetic oligonucleotide
  Target: ANGPTL3; (-) strand; PAM type: NRG; PAM sequence: GGG
atctaatctttagggattta

SEQ ID NO: 7823 - DNA, 20 bp, Artificial Sequence
  Description of Artificial Sequence: Synthetic oligonucleotide
  Target: ANGPTL3; (-) strand; PAM type: NRG; PAM sequence: AGG
tatctaatctttagggattt

SEQ ID NO: 7824 - DNA, 20 bp, Artificial Sequence
  Description of Artificial Sequence: Synthetic oligonucleotide
  Target: ANGPTL3; (-) strand; PAM type: NRG; PAM sequence: TAG
gtatctaatctttagggatt

SEQ ID NO: 7825 - DNA, 20 bp, Artificial Sequence
  Description of Artificial Sequence: Synthetic oligonucleotide
  Target: ANGPTL3; (-) strand; PAM type: NRG; PAM sequence: GGG
aaatttgtatctaatcttta

SEQ ID NO: 7826 - DNA, 20 bp, Artificial Sequence
  Description of Artificial Sequence: Synthetic oligonucleotide
  Target: ANGPTL3; (-) strand; PAM type: NRG; PAM sequence: AGG
aaaatttgtatctaatcttt

SEQ ID NO: 7827 - DNA, 20 bp, Artificial Sequence
  Description of Artificial Sequence: Synthetic oligonucleotide
  Target: ANGPTL3; (-) strand; PAM type: NRG; PAM sequence: TAG
aaaaatttgtatctaatctt

SEQ ID NO: 7828 - DNA, 20 bp, Artificial Sequence
  Description of Artificial Sequence: Synthetic oligonucleotide
  Target: ANGPTL3; (-) strand; PAM type: NRG; PAM sequence: TGG
aattctgacaagtgatactg

SEQ ID NO: 7829 - DNA, 20 bp, Artificial Sequence
  Description of Artificial Sequence: Synthetic oligonucleotide
  Target: ANGPTL3; (-) strand; PAM type: NRG; PAM sequence: AAG
atttaaaaataaattctgac

SEQ ID NO: 7830 - DNA, 20 bp, Artificial Sequence
  Description of Artificial Sequence: Synthetic oligonucleotide
  Target: ANGPTL3; (-) strand; PAM type: NRG; PAM sequence: CAG
aatttaaaatttcttactgg

SEQ ID NO: 7831 - DNA, 20 bp, Artificial Sequence
  Description of Artificial Sequence: Synthetic oligonucleotide
  Target: ANGPTL3; (-) strand; PAM type: NRG; PAM sequence: TGG
tttaatttaaaatttcttac

SEQ ID NO: 7832 - DNA, 20 bp, Artificial Sequence
  Description of Artificial Sequence: Synthetic oligonucleotide
  Target: ANGPTL3; (-) strand; PAM type: NRG; PAM sequence: GGG
cactatatcctttaacaaat

SEQ ID NO: 7833 - DNA, 20 bp, Artificial Sequence
  Description of Artificial Sequence: Synthetic oligonucleotide
  Target: ANGPTL3; (-) strand; PAM type: NRG; PAM sequence: TGG
gcactatatcctttaacaaa

SEQ ID NO: 7834 - DNA, 20 bp, Artificial Sequence
  Description of Artificial Sequence: Synthetic oligonucleotide
  Target: ANGPTL3; (-) strand; PAM type: NRG; PAM sequence: GGG
ggtaggtcaccatataactt

SEQ ID NO: 7835 - DNA, 20 bp, Artificial Sequence
  Description of Artificial Sequence: Synthetic oligonucleotide
  Target: ANGPTL3; (-) strand; PAM type: NRG; PAM sequence: TGG
aggtaggtcaccatataact

SEQ ID NO: 7836 - DNA, 20 bp, Artificial Sequence
  Description of Artificial Sequence: Synthetic oligonucleotide
  Target: ANGPTL3; (-) strand; PAM type: NRG; PAM sequence: AGG
tgctaagtattgacaaaggt

SEQ ID NO: 7837 - DNA, 20 bp, Artificial Sequence
  Description of Artificial Sequence: Synthetic oligonucleotide
  Target: ANGPTL3; (-) strand; PAM type: NRG; PAM sequence: TAG
atgctaagtattgacaaagg

SEQ ID NO: 7838 - DNA, 20 bp, Artificial Sequence
  Description of Artificial Sequence: Synthetic oligonucleotide
  Target: ANGPTL3; (-) strand; PAM type: NRG; PAM sequence: AGG
ataatgctaagtattgacaa

SEQ ID NO: 7839 - DNA, 20 bp, Artificial Sequence
  Description of Artificial Sequence: Synthetic oligonucleotide
  Target: ANGPTL3; (-) strand; PAM type: NRG; PAM sequence: AAG
cataatgctaagtattgaca

SEQ ID NO: 7840 - DNA, 20 bp, Artificial Sequence
  Description of Artificial Sequence: Synthetic oligonucleotide
  Target: ANGPTL3; (-) strand; PAM type: NRG; PAM sequence: AAG
aatttgaaatacataatgct

SEQ ID NO: 7841 - DNA, 20 bp, Artificial Sequence
  Description of Artificial Sequence: Synthetic oligonucleotide
  Target: ANGPTL3; (-) strand; PAM type: NRG; PAM sequence: TGG
aatatatatgacatgtatat

SEQ ID NO: 7842 - DNA, 20 bp, Artificial Sequence
  Description of Artificial Sequence: Synthetic oligonucleotide
  Target: ANGPTL3; (-) strand; PAM type: NRG; PAM sequence: TAG
atatttacttaggattcaca

SEQ ID NO: 7843 - DNA, 20 bp, Artificial Sequence
  Description of Artificial Sequence: Synthetic oligonucleotide
  Target: ANGPTL3; (-) strand; PAM type: NRG; PAM sequence: AGG
ctggaacaaaatatttactt

SEQ ID NO: 7844 - DNA, 20 bp, Artificial Sequence
  Description of Artificial Sequence: Synthetic oligonucleotide
  Target: ANGPTL3; (-) strand; PAM type: NRG; PAM sequence: TAG
tctggaacaaaatatttact

SEQ ID NO: 7845 - DNA, 20 bp, Artificial Sequence
  Description of Artificial Sequence: Synthetic oligonucleotide
  Target: ANGPTL3; (-) strand; PAM type: NRG; PAM sequence: TGG
tttattattttgtacttttc

SEQ ID NO: 7846 - DNA, 20 bp, Artificial Sequence
  Description of Artificial Sequence: Synthetic oligonucleotide
  Target: ANGPTL3; (-) strand; PAM type: NRG; PAM sequence: TAG
gtctgtggtcctgaaaatta

SEQ ID NO: 7847 - DNA, 20 bp, Artificial Sequence
  Description of Artificial Sequence: Synthetic oligonucleotide
  Target: ANGPTL3; (-) strand; PAM type: NRG; PAM sequence: TGG
aatttcgacagcttagtctg

SEQ ID NO: 7848 - DNA, 20 bp, Artificial Sequence
  Description of Artificial Sequence: Synthetic oligonucleotide
  Target: ANGPTL3; (-) strand; PAM type: NRG; PAM sequence: TAG
cagcgttaatttcgacagct

SEQ ID NO: 7849 - DNA, 20 bp, Artificial Sequence
  Description of Artificial Sequence: Synthetic oligonucleotide
  Target: ANGPTL3; (-) strand; PAM type: NRG; PAM sequence: CAG
aaaatcagcgttaatttcga

SEQ ID NO: 7850 - DNA, 20 bp, Artificial Sequence
  Description of Artificial Sequence: Synthetic oligonucleotide
  Target: ANGPTL3; (-) strand; PAM type: NRG; PAM sequence: CAG
tattctggccctaaaaaaat

SEQ ID NO: 7851 - DNA, 20 bp, Artificial Sequence
  Description of Artificial Sequence: Synthetic oligonucleotide
  Target: ANGPTL3; (-) strand; PAM type: NRG; PAM sequence: TGG
gaggagccattttggtattc

SEQ ID NO: 7852 - DNA, 20 bp, Artificial Sequence
  Description of Artificial Sequence: Synthetic oligonucleotide
  Target: ANGPTL3; (-) strand; PAM type: NRG; PAM sequence: TGG
ggggaagagaggagccattt

SEQ ID NO: 7853 - DNA, 20 bp, Artificial Sequence
  Description of Artificial Sequence: Synthetic oligonucleotide
  Target: ANGPTL3; (-) strand; PAM type: NRG; PAM sequence: GAG
ccaattttgggggaagagag

SEQ ID NO: 7854 - DNA, 20 bp, Artificial Sequence
  Description of Artificial Sequence: Synthetic oligonucleotide
  Target: ANGPTL3; (-) strand; PAM type: NRG; PAM sequence: AGG
gtccaattttgggggaagag

SEQ ID NO: 7855 - DNA, 20 bp, Artificial Sequence
  Description of Artificial Sequence: Synthetic oligonucleotide
  Target: ANGPTL3; (-) strand; PAM type: NRG; PAM sequence: GAG
tgtccaattttgggggaaga

SEQ ID NO: 7856 - DNA, 20 bp, Artificial Sequence
  Description of Artificial Sequence: Synthetic oligonucleotide
  Target: ANGPTL3; (-) strand; PAM type: NRG; PAM sequence: GAG
attgtccaattttgggggaa

SEQ ID NO: 7857 - DNA, 20 bp, Artificial Sequence
  Description of Artificial Sequence: Synthetic oligonucleotide
  Target: ANGPTL3; (-) strand; PAM type: NRG; PAM sequence: AAG
aaattgtccaattttggggg

SEQ ID NO: 7858 - DNA, 20 bp, Artificial Sequence
  Description of Artificial Sequence: Synthetic oligonucleotide
  Target: ANGPTL3; (-) strand; PAM type: NRG; PAM sequence: GGG
ttgaaattgtccaattttgg

SEQ ID NO: 7859 - DNA, 20 bp, Artificial Sequence
  Description of Artificial Sequence: Synthetic oligonucleotide
  Target: ANGPTL3; (-) strand; PAM type: NRG; PAM sequence: GGG
tttgaaattgtccaattttg

SEQ ID NO: 7860 - DNA, 20 bp, Artificial Sequence
  Description of Artificial Sequence: Synthetic oligonucleotide
  Target: ANGPTL3; (-) strand; PAM type: NRG; PAM sequence: GGG
atttgaaattgtccaatttt

SEQ ID NO: 7861 - DNA, 20 bp, Artificial Sequence
  Description of Artificial Sequence: Synthetic oligonucleotide
  Target: ANGPTL3; (-) strand; PAM type: NRG; PAM sequence: TGG
catttgaaattgtccaattt

SEQ ID NO: 7862 - DNA, 20 bp, Artificial Sequence
  Description of Artificial Sequence: Synthetic oligonucleotide
  Target: ANGPTL3; (-) strand; PAM type: NRG; PAM sequence: AAG
ttaaggaaaccaaatagagg

SEQ ID NO: 7863 - DNA, 20 bp, Artificial Sequence
  Description of Artificial Sequence: Synthetic oligonucleotide
  Target: ANGPTL3; (-) strand; PAM type: NRG; PAM sequence: AGG
tttttaaggaaaccaaatag

SEQ ID NO: 7864 - DNA, 20 bp, Artificial Sequence
  Description of Artificial Sequence: Synthetic oligonucleotide
  Target: ANGPTL3; (-) strand; PAM type: NRG; PAM sequence: GAG
ttttttaaggaaaccaaata

SEQ ID NO: 7865 - DNA, 20 bp, Artificial Sequence
  Description of Artificial Sequence: Synthetic oligonucleotide
  Target: ANGPTL3; (-) strand; PAM type: NRG; PAM sequence: TAG
ttttttttaaggaaaccaaa

SEQ ID NO: 7866 - DNA, 20 bp, Artificial Sequence
  Description of Artificial Sequence: Synthetic oligonucleotide
  Target: ANGPTL3; (-) strand; PAM type: NRG; PAM sequence: AGG
gagagtttttttttttttta

SEQ ID NO: 7867 - DNA, 20 bp, Artificial Sequence
  Description of Artificial Sequence: Synthetic oligonucleotide
  Target: ANGPTL3; (-) strand; PAM type: NRG; PAM sequence: AAG
tgagagtttttttttttttt

SEQ ID NO: 7868 - DNA, 20 bp, Artificial Sequence
  Description of Artificial Sequence: Synthetic oligonucleotide
  Target: ANGPTL3; (-) strand; PAM type: NRG; PAM sequence: GAG
aaatgaaacatgtcctatga

SEQ ID NO: 7869 - DNA, 20 bp, Artificial Sequence
  Description of Artificial Sequence: Synthetic oligonucleotide
  Target: ANGPTL3; (-) strand; PAM type: NRG; PAM sequence: GAG
caaaatgaaacatgtcctat

SEQ ID NO: 7870 - DNA, 20 bp, Artificial Sequence
  Description of Artificial Sequence: Synthetic oligonucleotide
  Target: ANGPTL3; (-) strand; PAM type: NRG; PAM sequence: AGG
tctaatttactactcctgaa

SEQ ID NO: 7871 - DNA, 20 bp, Artificial Sequence
  Description of Artificial Sequence: Synthetic oligonucleotide
  Target: ANGPTL3; (-) strand; PAM type: NRG; PAM sequence: AAG
gtctaatttactactcctga

SEQ ID NO: 7872 - DNA, 20 bp, Artificial Sequence
  Description of Artificial Sequence: Synthetic oligonucleotide
  Target: ANGPTL3; (-) strand; PAM type: NRG; PAM sequence: GGG
gtagaaaaaagctttatatg

SEQ ID NO: 7873 - DNA, 20 bp, Artificial Sequence
  Description of Artificial Sequence: Synthetic oligonucleotide
  Target: ANGPTL3; (-) strand; PAM type: NRG; PAM sequence: GGG
ggtagaaaaaagctttatat

SEQ ID NO: 7874 - DNA, 20 bp, Artificial Sequence
  Description of Artificial Sequence: Synthetic oligonucleotide
  Target: ANGPTL3; (-) strand; PAM type: NRG; PAM sequence: TGG
tggtagaaaaaagctttata

SEQ ID NO: 7875 - DNA, 20 bp, Artificial Sequence
  Description of Artificial Sequence: Synthetic oligonucleotide
  Target: ANGPTL3; (-) strand; PAM type: NRG; PAM sequence: AAG
agtatctttctggtagaaaa

SEQ ID NO: 7876 - DNA, 20 bp, Artificial Sequence
  Description of Artificial Sequence: Synthetic oligonucleotide
  Target: ANGPTL3; (-) strand; PAM type: NRG; PAM sequence: TAG
taccagaagtatctttctgg

SEQ ID NO: 7877 - DNA, 20 bp, Artificial Sequence
  Description of Artificial Sequence: Synthetic oligonucleotide
  Target: ANGPTL3; (-) strand; PAM type: NRG; PAM sequence: TGG
ttctaccagaagtatctttc

SEQ ID NO: 7878 - DNA, 20 bp, Artificial Sequence
  Description of Artificial Sequence: Synthetic oligonucleotide
  Target: ANGPTL3; (-) strand; PAM type: NRG; PAM sequence: AAG
cctttctcttcttctaccag

SEQ ID NO: 7879 - DNA, 20 bp, Artificial Sequence
  Description of Artificial Sequence: Synthetic oligonucleotide
  Target: ANGPTL3; (-) strand; PAM type: NRG; PAM sequence: CAG
gctcctttctcttcttctac

SEQ ID NO: 7880 - DNA, 20 bp, Artificial Sequence
  Description of Artificial Sequence: Synthetic oligonucleotide
  Target: ANGPTL3; (-) strand; PAM type: NRG; PAM sequence: GAG
acagtcgtgtgaaccataaa

SEQ ID NO: 7881 - DNA, 20 bp, Artificial Sequence
  Description of Artificial Sequence: Synthetic oligonucleotide
  Target: ANGPTL3; (-) strand; PAM type: NRG; PAM sequence: AAG
agacagtcgtgtgaaccata

SEQ ID NO: 7882 - DNA, 20 bp, Artificial Sequence
  Description of Artificial Sequence: Synthetic oligonucleotide
  Target: ANGPTL3; (-) strand; PAM type: NRG; PAM sequence: CAG
aaagtagttaggacaggaga

SEQ ID NO: 7883 - DNA, 20 bp, Artificial Sequence
  Description of Artificial Sequence: Synthetic oligonucleotide
  Target: ANGPTL3; (-) strand; PAM type: NRG; PAM sequence: GAG
aagcaaagtagttaggacag

SEQ ID NO: 7884 - DNA, 20 bp, Artificial Sequence
  Description of Artificial Sequence: Synthetic oligonucleotide
  Target: ANGPTL3; (-) strand; PAM type: NRG; PAM sequence: AGG
ttaagcaaagtagttaggac

SEQ ID NO: 7885 - DNA, 20 bp, Artificial Sequence
  Description of Artificial Sequence: Synthetic oligonucleotide
  Target: ANGPTL3; (-) strand; PAM type: NRG; PAM sequence: CAG
tttaagcaaagtagttagga

SEQ ID NO: 7886 - DNA, 20 bp, Artificial Sequence
  Description of Artificial Sequence: Synthetic oligonucleotide
  Target: ANGPTL3; (-) strand; PAM type: NRG; PAM sequence: AGG
gcactttaagcaaagtagtt

SEQ ID NO: 7887 - DNA, 20 bp, Artificial Sequence
  Description of Artificial Sequence: Synthetic oligonucleotide
  Target: ANGPTL3; (-) strand; PAM type: NRG; PAM sequence: TAG
agcactttaagcaaagtagt

SEQ ID NO: 7888 - DNA, 20 bp, Artificial Sequence
  Description of Artificial Sequence: Synthetic oligonucleotide
  Target: ANGPTL3; (-) strand; PAM type: NRG; PAM sequence: TAG
tttgagcactttaagcaaag

SEQ ID NO: 7889 - DNA, 20 bp, Artificial Sequence
  Description of Artificial Sequence: Synthetic oligonucleotide
  Target: ANGPTL3; (-) strand; PAM type: NRG; PAM sequence: AAG
gaatttgagcactttaagca

SEQ ID NO: 7890 - DNA, 20 bp, Artificial Sequence
  Description of Artificial Sequence: Synthetic oligonucleotide
  Target: ANGPTL3; (-) strand; PAM type: NRG; PAM sequence: AAG
tgatggaatttgagcacttt

SEQ ID NO: 7891 - DNA, 20 bp, Artificial Sequence
  Description of Artificial Sequence: Synthetic oligonucleotide
  Target: ANGPTL3; (-) strand; PAM type: NRG; PAM sequence: GAG
tgtgagtagtgatggaattt

SEQ ID NO: 7892 - DNA, 20 bp, Artificial Sequence
  Description of Artificial Sequence: Synthetic oligonucleotide
  Target: ANGPTL3; (-) strand; PAM type: NRG; PAM sequence: TGG
tagacaactgtgagtagtga

SEQ ID NO: 7893 - DNA, 20 bp, Artificial Sequence
  Description of Artificial Sequence: Synthetic oligonucleotide
  Target: ANGPTL3; (-) strand; PAM type: NRG; PAM sequence: TAG
ttagattagacaactgtgag

SEQ ID NO: 7894 - DNA, 20 bp, Artificial Sequence
  Description of Artificial Sequence: Synthetic oligonucleotide
  Target: ANGPTL3; (-) strand; PAM type: NRG; PAM sequence: GAG
gacttagattagacaactgt

SEQ ID NO: 7895 - DNA, 20 bp, Artificial Sequence
  Description of Artificial Sequence: Synthetic oligonucleotide
  Target: ANGPTL3; (-) strand; PAM type: NRG; PAM sequence: TAG
aaaggggattagacttagat

SEQ ID NO: 7896 - DNA, 20 bp, Artificial Sequence
  Description of Artificial Sequence: Synthetic oligonucleotide
  Target: ANGPTL3; (-) strand; PAM type: NRG; PAM sequence: TAG
agatcaaaggggattagact

SEQ ID NO: 7897 - DNA, 20 bp, Artificial Sequence
  Description of Artificial Sequence: Synthetic oligonucleotide
  Target: ANGPTL3; (-) strand; PAM type: NRG; PAM sequence: TAG
tctgagagatcaaaggggat

SEQ ID NO: 7898 - DNA, 20 bp, Artificial Sequence
  Description of Artificial Sequence: Synthetic oligonucleotide
  Target: ANGPTL3; (-) strand; PAM type: NRG; PAM sequence: GGG
ggtagtctgagagatcaaag

SEQ ID NO: 7899 - DNA, 20 bp, Artificial Sequence
  Description of Artificial Sequence: Synthetic oligonucleotide
  Target: ANGPTL3; (-) strand; PAM type: NRG; PAM sequence: GGG
aggtagtctgagagatcaaa

SEQ ID NO: 7900 - DNA, 20 bp, Artificial Sequence
  Description of Artificial Sequence: Synthetic oligonucleotide
  Target: ANGPTL3; (-) strand; PAM type: NRG; PAM sequence: AGG
aaggtagtctgagagatcaa

SEQ ID NO: 7901 - DNA, 20 bp, Artificial Sequence
  Description of Artificial Sequence: Synthetic oligonucleotide
  Target: ANGPTL3; (-) strand; PAM type: NRG; PAM sequence: AAG
gaaggtagtctgagagatca

SEQ ID NO: 7902 - DNA, 20 bp, Artificial Sequence
  Description of Artificial Sequence: Synthetic oligonucleotide
  Target: ANGPTL3; (-) strand; PAM type: NRG; PAM sequence: GAG
taaaagggaaggtagtctga

SEQ ID NO: 7903 - DNA, 20 bp, Artificial Sequence
  Description of Artificial Sequence: Synthetic oligonucleotide
  Target: ANGPTL3; (-) strand; PAM type: NRG; PAM sequence: GAG
gataaaagggaaggtagtct

SEQ ID NO: 7904 - DNA, 20 bp, Artificial Sequence
  Description of Artificial Sequence: Synthetic oligonucleotide
  Target: ANGPTL3; (-) strand; PAM type: NRG; PAM sequence: TAG
tagagagataaaagggaagg

SEQ ID NO: 7905 - DNA, 20 bp, Artificial Sequence
  Description of Artificial Sequence: Synthetic oligonucleotide
  Target: ANGPTL3; (-) strand; PAM type: NRG; PAM sequence: AGG
tagtagagagataaaaggga

SEQ ID NO: 7906 - DNA, 20 bp, Artificial Sequence
  Description of Artificial Sequence: Synthetic oligonucleotide
  Target: ANGPTL3; (-) strand; PAM type: NRG; PAM sequence: AAG
gtagtagagagataaaaggg

SEQ ID NO: 7907 - DNA, 20 bp, Artificial Sequence
  Description of Artificial Sequence: Synthetic oligonucleotide
  Target: ANGPTL3; (-) strand; PAM type: NRG; PAM sequence: GGG
taagtagtagagagataaaa

SEQ ID NO: 7908 - DNA, 20 bp, Artificial Sequence
  Description of Artificial Sequence: Synthetic oligonucleotide
  Target: ANGPTL3; (-) strand; PAM type: NRG; PAM sequence: AGG
ttaagtagtagagagataaa

SEQ ID NO: 7909 - DNA, 20 bp, Artificial Sequence
  Description of Artificial Sequence: Synthetic oligonucleotide
  Target: ANGPTL3; (-) strand; PAM type: NRG; PAM sequence: AAG
attaagtagtagagagataa

SEQ ID NO: 7910 - DNA, 20 bp, Artificial Sequence
  Description of Artificial Sequence: Synthetic oligonucleotide
  Target: ANGPTL3; (-) strand; PAM type: NRG; PAM sequence: GAG
tcttattattaagtagtaga

SEQ ID NO: 7911 - DNA, 20 bp, Artificial Sequence
  Description of Artificial Sequence: Synthetic oligonucleotide
  Target: ANGPTL3; (-) strand; PAM type: NRG; PAM sequence: GAG
attcttattattaagtagta

SEQ ID NO: 7912 - DNA, 20 bp, Artificial Sequence
  Description of Artificial Sequence: Synthetic oligonucleotide
  Target: ANGPTL3; (-) strand; PAM type: NRG; PAM sequence: TAG
atattcttattattaagtag

SEQ ID NO: 7913 - DNA, 20 bp, Artificial Sequence
  Description of Artificial Sequence: Synthetic oligonucleotide
  Target: ANGPTL3; (-) strand; PAM type: NRG; PAM sequence: TAG
aagatattcttattattaag

SEQ ID NO: 7914 - DNA, 20 bp, Artificial Sequence
  Description of Artificial Sequence: Synthetic oligonucleotide
  Target: ANGPTL3; (-) strand; PAM type: NRG; PAM sequence: AAG
aaaaagatattcttattatt

SEQ ID NO: 7915 - DNA, 20 bp, Artificial Sequence
  Description of Artificial Sequence: Synthetic oligonucleotide
  Target: ANGPTL3; (-) strand; PAM type: NRG; PAM sequence: AAG
tgaaggtcaagtttgaaaaa

SEQ ID NO: 7916 - DNA, 20 bp, Artificial Sequence
  Description of Artificial Sequence: Synthetic oligonucleotide
  Target: ANGPTL3; (-) strand; PAM type: NRG; PAM sequence: AAG
gtgaaagcaaaatgaaggtc

SEQ ID NO: 7917 - DNA, 20 bp, Artificial Sequence
  Description of Artificial Sequence: Synthetic oligonucleotide
  Target: ANGPTL3; (-) strand; PAM type: NRG; PAM sequence: AGG
gtattgtgaaagcaaaatga

SEQ ID NO: 7918 - DNA, 20 bp, Artificial Sequence
  Description of Artificial Sequence: Synthetic oligonucleotide
  Target: ANGPTL3; (-) strand; PAM type: NRG; PAM sequence: AAG
agtattgtgaaagcaaaatg

SEQ ID NO: 7919 - DNA, 20 bp, Artificial Sequence
  Description of Artificial Sequence: Synthetic oligonucleotide
  Target: ANGPTL3; (-) strand; PAM type: NRG; PAM sequence: AAG
tggagagtatagtattgtga

SEQ ID NO: 7920 - DNA, 20 bp, Artificial Sequence
  Description of Artificial Sequence: Synthetic oligonucleotide
  Target: ANGPTL3; (-) strand; PAM type: NRG; PAM sequence: TAG
gggataatccatggagagta

SEQ ID NO: 7921 - DNA, 20 bp, Artificial Sequence
  Description of Artificial Sequence: Synthetic oligonucleotide
  Target: ANGPTL3; (-) strand; PAM type: NRG; PAM sequence: GAG
gataagggataatccatgga

SEQ ID NO: 7922 - DNA, 20 bp, Artificial Sequence
  Description of Artificial Sequence: Synthetic oligonucleotide
  Target: ANGPTL3; (-) strand; PAM type: NRG; PAM sequence: GAG
cagataagggataatccatg

SEQ ID NO: 7923 - DNA, 20 bp, Artificial Sequence
  Description of Artificial Sequence: Synthetic oligonucleotide
  Target: ANGPTL3; (-) strand; PAM type: NRG; PAM sequence: TGG
ttcagataagggataatcca

SEQ ID NO: 7924 - DNA, 20 bp, Artificial Sequence
  Description of Artificial Sequence: Synthetic oligonucleotide
  Target: ANGPTL3; (-) strand; PAM type: NRG; PAM sequence: GGG
ataaagatggattcagataa

SEQ ID NO: 7925 - DNA, 20 bp, Artificial Sequence
  Description of Artificial Sequence: Synthetic oligonucleotide
  Target: ANGPTL3; (-) strand; PAM type: NRG; PAM sequence: AGG
tataaagatggattcagata

SEQ ID NO: 7926 - DNA, 20 bp, Artificial Sequence
  Description of Artificial Sequence: Synthetic oligonucleotide
  Target: ANGPTL3; (-) strand; PAM type: NRG; PAM sequence: AAG
ttataaagatggattcagat

SEQ ID NO: 7927 - DNA, 20 bp, Artificial Sequence
  Description of Artificial Sequence: Synthetic oligonucleotide
  Target: ANGPTL3; (-) strand; PAM type: NRG; PAM sequence: CAG
tagggttataaagatggatt

SEQ ID NO: 7928 - DNA, 20 bp, Artificial Sequence
  Description of Artificial Sequence: Synthetic oligonucleotide
  Target: ANGPTL3; (-) strand; PAM type: NRG; PAM sequence: TGG
aaggaatagggttataaaga

SEQ ID NO: 7929 - DNA, 20 bp, Artificial Sequence
  Description of Artificial Sequence: Synthetic oligonucleotide
  Target: ANGPTL3; (-) strand; PAM type: NRG; PAM sequence: AAG
gagaaaggaatagggttata

SEQ ID NO: 7930 - DNA, 20 bp, Artificial Sequence
  Description of Artificial Sequence: Synthetic oligonucleotide
  Target: ANGPTL3; (-) strand; PAM type: NRG; PAM sequence: GGG
ctaaatatgagaaaggaata

SEQ ID NO: 7931 - DNA, 20 bp, Artificial Sequence
  Description of Artificial Sequence: Synthetic oligonucleotide
  Target: ANGPTL3; (-) strand; PAM type: NRG; PAM sequence: AGG
actaaatatgagaaaggaat

SEQ ID NO: 7932 - DNA, 20 bp, Artificial Sequence
  Description of Artificial Sequence: Synthetic oligonucleotide
  Target: ANGPTL3; (-) strand; PAM type: NRG; PAM sequence: TAG
tactaaatatgagaaaggaa

SEQ ID NO: 7933 - DNA, 20 bp, Artificial Sequence
  Description of Artificial Sequence: Synthetic oligonucleotide
  Target: ANGPTL3; (-) strand; PAM type: NRG; PAM sequence: AGG
cacagtactaaatatgagaa

SEQ ID NO: 7934 - DNA, 20 bp, Artificial Sequence
  Description of Artificial Sequence: Synthetic oligonucleotide
  Target: ANGPTL3; (-) strand; PAM type: NRG; PAM sequence: AAG
ccacagtactaaatatgaga

SEQ ID NO: 7935 - DNA, 20 bp, Artificial Sequence
  Description of Artificial Sequence: Synthetic oligonucleotide
  Target: ANGPTL3; (-) strand; PAM type: NRG; PAM sequence: GAG
tggcccacagtactaaatat

SEQ ID NO: 7936 - DNA, 20 bp, Artificial Sequence
  Description of Artificial Sequence: Synthetic oligonucleotide
  Target: ANGPTL3; (-) strand; PAM type: NRG; PAM sequence: CAG
gaaggttgtccattggccca

SEQ ID NO: 7937 - DNA, 20 bp, Artificial Sequence
  Description of Artificial Sequence: Synthetic oligonucleotide
  Target: ANGPTL3; (-) strand; PAM type: NRG; PAM sequence: TGG
gatgattgaaggttgtccat

SEQ ID NO: 7938 - DNA, 20 bp, Artificial Sequence
  Description of Artificial Sequence: Synthetic oligonucleotide
  Target: ANGPTL3; (-) strand; PAM type: NRG; PAM sequence: AGG
agtgtagaaaagatgattga

SEQ ID NO: 7939 - DNA, 20 bp, Artificial Sequence
  Description of Artificial Sequence: Synthetic oligonucleotide
  Target: ANGPTL3; (-) strand; PAM type: NRG; PAM sequence: AAG
cagtgtagaaaagatgattg

SEQ ID NO: 7940 - DNA, 20 bp, Artificial Sequence
  Description of Artificial Sequence: Synthetic oligonucleotide
  Target: ANGPTL3; (-) strand; PAM type: NRG; PAM sequence: AAG
gtctgagggtcagtgtagaa

SEQ ID NO: 7941 - DNA, 20 bp, Artificial Sequence
  Description of Artificial Sequence: Synthetic oligonucleotide
  Target: ANGPTL3; (-) strand; PAM type: NRG; PAM sequence: TAG
agaatgtctgagggtcagtg

SEQ ID NO: 7942 - DNA, 20 bp, Artificial Sequence
  Description of Artificial Sequence: Synthetic oligonucleotide
  Target: ANGPTL3; (-) strand; PAM type: NRG; PAM sequence: CAG
cagatagaatgtctgagggt

SEQ ID NO: 7943 - DNA, 20 bp, Artificial Sequence
  Description of Artificial Sequence: Synthetic oligonucleotide
  Target: ANGPTL3; (-) strand; PAM type: NRG; PAM sequence: GGG
agagcagatagaatgtctga

SEQ ID NO: 7944 - DNA, 20 bp, Artificial Sequence
  Description of Artificial Sequence: Synthetic oligonucleotide
  Target: ANGPTL3; (-) strand; PAM type: NRG; PAM sequence: AGG
gagagcagatagaatgtctg

SEQ ID NO: 7945 - DNA, 20 bp, Artificial Sequence
  Description of Artificial Sequence: Synthetic oligonucleotide
  Target: ANGPTL3; (-) strand; PAM type: NRG; PAM sequence: GAG
tgagagcagatagaatgtct

SEQ ID NO: 7946 - DNA, 20 bp, Artificial Sequence
  Description of Artificial Sequence: Synthetic oligonucleotide
  Target: ANGPTL3; (-) strand; PAM type: NRG; PAM sequence: TAG
aaggagtccgtgagagcaga

SEQ ID NO: 7947 - DNA, 20 bp, Artificial Sequence
  Description of Artificial Sequence: Synthetic oligonucleotide
  Target: ANGPTL3; (-) strand; PAM type: NRG; PAM sequence: CAG
aataaaggagtccgtgagag

SEQ ID NO: 7948 - DNA, 20 bp, Artificial Sequence
  Description of Artificial Sequence: Synthetic oligonucleotide
  Target: ANGPTL3; (-) strand; PAM type: NRG; PAM sequence: GAG
gtaaataaaggagtccgtga

SEQ ID NO: 7949 - DNA, 20 bp, Artificial Sequence
  Description of Artificial Sequence: Synthetic oligonucleotide
  Target: ANGPTL3; (-) strand; PAM type: NRG; PAM sequence: GAG
tggtaaataaaggagtccgt

SEQ ID NO: 7950 - DNA, 20 bp, Artificial Sequence
  Description of Artificial Sequence: Synthetic oligonucleotide
  Target: ANGPTL3; (-) strand; PAM type: NRG; PAM sequence: GAG
tttattcatggtaaataaag

SEQ ID NO: 7951 - DNA, 20 bp, Artificial Sequence
  Description of Artificial Sequence: Synthetic oligonucleotide
  Target: ANGPTL3; (-) strand; PAM type: NRG; PAM sequence: AGG
actttattcatggtaaataa

SEQ ID NO: 7952 - DNA, 20 bp, Artificial Sequence
  Description of Artificial Sequence: Synthetic oligonucleotide
  Target: ANGPTL3; (-) strand; PAM type: NRG; PAM sequence: AAG
aactttattcatggtaaata

SEQ ID NO: 7953 - DNA, 20 bp, Artificial Sequence
  Description of Artificial Sequence: Synthetic oligonucleotide
  Target: ANGPTL3; (-) strand; PAM type: NRG; PAM sequence: TGG
agattttggaactttattca

SEQ ID NO: 7954 - DNA, 20 bp, Artificial Sequence
  Description of Artificial Sequence: Synthetic oligonucleotide
  Target: ANGPTL3; (-) strand; PAM type: NRG; PAM sequence: TGG
tgggatgaatatgtagattt

SEQ ID NO: 7955 - DNA, 20 bp, Artificial Sequence
  Description of Artificial Sequence: Synthetic oligonucleotide
  Target: ANGPTL3; (-) strand; PAM type: NRG; PAM sequence: TAG
agagacttgggatgaatatg

SEQ ID NO: 7956 - DNA, 20 bp, Artificial Sequence
  Description of Artificial Sequence: Synthetic oligonucleotide
  Target: ANGPTL3; (-) strand; PAM type: NRG; PAM sequence: GGG
ggggaactggaaagagactt

SEQ ID NO: 7957 - DNA, 20 bp, Artificial Sequence
  Description of Artificial Sequence: Synthetic oligonucleotide
  Target: ANGPTL3; (-) strand; PAM type: NRG; PAM sequence: TGG
aggggaactggaaagagact

SEQ ID NO: 7958 - DNA, 20 bp, Artificial Sequence
  Description of Artificial Sequence: Synthetic oligonucleotide
  Target: ANGPTL3; (-) strand; PAM type: NRG; PAM sequence: GAG
gtaagaaggggaactggaaa

SEQ ID NO: 7959 - DNA, 20 bp, Artificial Sequence
  Description of Artificial Sequence: Synthetic oligonucleotide
  Target: ANGPTL3; (-) strand; PAM type: NRG; PAM sequence: AAG
atgtaagaaggggaactgga

SEQ ID NO: 7960 - DNA, 20 bp, Artificial Sequence
  Description of Artificial Sequence: Synthetic oligonucleotide
  Target: ANGPTL3; (-) strand; PAM type: NRG; PAM sequence: TGG
ggcaatgtaagaaggggaac

SEQ ID NO: 7961 - DNA, 20 bp, Artificial Sequence
  Description of Artificial Sequence: Synthetic oligonucleotide
  Target: ANGPTL3; (-) strand; PAM type: NRG; PAM sequence: GGG
caaataggcaatgtaagaag

SEQ ID NO: 7962 - DNA, 20 bp, Artificial Sequence
  Description of Artificial Sequence: Synthetic oligonucleotide
  Target: ANGPTL3; (-) strand; PAM type: NRG; PAM sequence: GGG
gcaaataggcaatgtaagaa

SEQ ID NO: 7963 - DNA, 20 bp, Artificial Sequence
  Description of Artificial Sequence: Synthetic oligonucleotide
  Target: ANGPTL3; (-) strand; PAM type: NRG; PAM sequence: AGG
ggcaaataggcaatgtaaga

SEQ ID NO: 7964 - DNA, 20 bp, Artificial Sequence
  Description of Artificial Sequence: Synthetic oligonucleotide
  Target: ANGPTL3; (-) strand; PAM type: NRG; PAM sequence: AAG
tggcaaataggcaatgtaag

SEQ ID NO: 7965 - DNA, 20 bp, Artificial Sequence
  Description of Artificial Sequence: Synthetic oligonucleotide
  Target: ANGPTL3; (-) strand; PAM type: NRG; PAM sequence: AAG
aaatggcaaataggcaatgt

SEQ ID NO: 7966 - DNA, 20 bp, Artificial Sequence
  Description of Artificial Sequence: Synthetic oligonucleotide
  Target: ANGPTL3; (-) strand; PAM type: NRG; PAM sequence: AGG
tgaagggagaaatggcaaat

SEQ ID NO: 7967 - DNA, 20 bp, Artificial Sequence
  Description of Artificial Sequence: Synthetic oligonucleotide
  Target: ANGPTL3; (-) strand; PAM type: NRG; PAM sequence: TAG
ttgaagggagaaatggcaaa

SEQ ID NO: 7968 - DNA, 20 bp, Artificial Sequence
  Description of Artificial Sequence: Synthetic oligonucleotide
  Target: ANGPTL3; (-) strand; PAM type: NRG; PAM sequence: TGG
tagggtattgaagggagaaa

SEQ ID NO: 7969 - DNA, 20 bp, Artificial Sequence
  Description of Artificial Sequence: Synthetic oligonucleotide
  Target: ANGPTL3; (-) strand; PAM type: NRG; PAM sequence: GAG
gaagtatagggtattgaagg

SEQ ID NO: 7970 - DNA, 20 bp, Artificial Sequence
  Description of Artificial Sequence: Synthetic oligonucleotide
  Target: ANGPTL3; (-) strand; PAM type: NRG; PAM sequence: GGG
gtgaagtatagggtattgaa

SEQ ID NO: 7971 - DNA, 20 bp, Artificial Sequence
  Description of Artificial Sequence: Synthetic oligonucleotide
  Target: ANGPTL3; (-) strand; PAM type: NRG; PAM sequence: AGG
agtgaagtatagggtattga

SEQ ID NO: 7972 - DNA, 20 bp, Artificial Sequence
  Description of Artificial Sequence: Synthetic oligonucleotide
  Target: ANGPTL3; (-) strand; PAM type: NRG; PAM sequence: AAG
gagtgaagtatagggtattg

SEQ ID NO: 7973 - DNA, 20 bp, Artificial Sequence
  Description of Artificial Sequence: Synthetic oligonucleotide
  Target: ANGPTL3; (-) strand; PAM type: NRG; PAM sequence: GGG
ttgaatttgagtgaagtata

SEQ ID NO: 7974 - DNA, 20 bp, Artificial Sequence
  Description of Artificial Sequence: Synthetic oligonucleotide
  Target: ANGPTL3; (-) strand; PAM type: NRG; PAM sequence: AGG
gttgaatttgagtgaagtat

SEQ ID NO: 7975 - DNA, 20 bp, Artificial Sequence
  Description of Artificial Sequence: Synthetic oligonucleotide
  Target: ANGPTL3; (-) strand; PAM type: NRG; PAM sequence: TAG
tgttgaatttgagtgaagta

SEQ ID NO: 7976 - DNA, 20 bp, Artificial Sequence
  Description of Artificial Sequence: Synthetic oligonucleotide
  Target: ANGPTL3; (-) strand; PAM type: NRG; PAM sequence: AAG
tggtatgttgaatttgagtg

SEQ ID NO: 7977 - DNA, 20 bp, Artificial Sequence
  Description of Artificial Sequence: Synthetic oligonucleotide
  Target: ANGPTL3; (-) strand; PAM type: NRG; PAM sequence: GAG
atttttggtatgttgaattt

SEQ ID NO: 7978 - DNA, 20 bp, Artificial Sequence
  Description of Artificial Sequence: Synthetic oligonucleotide
  Target: ANGPTL3; (-) strand; PAM type: NRG; PAM sequence: TGG
cgtgcctggccttttatttt

SEQ ID NO: 7979 - DNA, 20 bp, Artificial Sequence
  Description of Artificial Sequence: Synthetic oligonucleotide
  Target: ANGPTL3; (-) strand; PAM type: NRG; PAM sequence: TGG
caggtgtgagccaccgtgcc

SEQ ID NO: 7980 - DNA, 20 bp, Artificial Sequence
  Description of Artificial Sequence: Synthetic oligonucleotide
  Target: ANGPTL3; (-) strand; PAM type: NRG; PAM sequence: GAG
agtcctgggattacaggtgt

SEQ ID NO: 7981 - DNA, 20 bp, Artificial Sequence
  Description of Artificial Sequence: Synthetic oligonucleotide
  Target: ANGPTL3; (-) strand; PAM type: NRG; PAM sequence: AGG
tcccaaagtcctgggattac

SEQ ID NO: 7982 - DNA, 20 bp, Artificial Sequence
  Description of Artificial Sequence: Synthetic oligonucleotide
  Target: ANGPTL3; (-) strand; PAM type: NRG; PAM sequence: CAG
ctcccaaagtcctgggatta

SEQ ID NO: 7983 - DNA, 20 bp, Artificial Sequence
  Description of Artificial Sequence: Synthetic oligonucleotide
  Target: ANGPTL3; (-) strand; PAM type: NRG; PAM sequence: GGG
cctcagcctcccaaagtcct

SEQ ID NO: 7984 - DNA, 20 bp, Artificial Sequence
  Description of Artificial Sequence: Synthetic oligonucleotide
  Target: ANGPTL3; (-) strand; PAM type: NRG; PAM sequence: TGG
gcctcagcctcccaaagtcc

SEQ ID NO: 7985 - DNA, 20 bp, Artificial Sequence
  Description of Artificial Sequence: Synthetic oligonucleotide
  Target: ANGPTL3; (-) strand; PAM type: NRG; PAM sequence: AAG
ccacctgcctcagcctccca

SEQ ID NO: 7986 - DNA, 20 bp, Artificial Sequence
  Description of Artificial Sequence: Synthetic oligonucleotide
  Target: ANGPTL3; (-) strand; PAM type: NRG; PAM sequence: CAG
ctcaggtgatccacctgcct

SEQ ID NO: 7987 - DNA, 20 bp, Artificial Sequence
  Description of Artificial Sequence: Synthetic oligonucleotide
  Target: ANGPTL3; (-) strand; PAM type: NRG; PAM sequence: AGG
ctggtcagactcctgacctc

SEQ ID NO: 7988 - DNA, 20 bp, Artificial Sequence
  Description of Artificial Sequence: Synthetic oligonucleotide
  Target: ANGPTL3; (-) strand; PAM type: NRG; PAM sequence: CAG
gctggtcagactcctgacct

SEQ ID NO: 7989 - DNA, 20 bp, Artificial Sequence
  Description of Artificial Sequence: Synthetic oligonucleotide
  Target: ANGPTL3; (-) strand; PAM type: NRG; PAM sequence: CAG
accatattggtcaggctggt

SEQ ID NO: 7990 - DNA, 20 bp, Artificial Sequence
  Description of Artificial Sequence: Synthetic oligonucleotide
  Target: ANGPTL3; (-) strand; PAM type: NRG; PAM sequence: TGG
tttcaccatattggtcaggc

SEQ ID NO: 7991 - DNA, 20 bp, Artificial Sequence
  Description of Artificial Sequence: Synthetic oligonucleotide
  Target: ANGPTL3; (-) strand; PAM type: NRG; PAM sequence: AGG
ggggtttcaccatattggtc

SEQ ID NO: 7992 - DNA, 20 bp, Artificial Sequence
  Description of Artificial Sequence: Synthetic oligonucleotide
  Target: ANGPTL3; (-) strand; PAM type: NRG; PAM sequence: CAG
cggggtttcaccatattggt

SEQ ID NO: 7993 - DNA, 20 bp, Artificial Sequence
  Description of Artificial Sequence: Synthetic oligonucleotide
  Target: ANGPTL3; (-) strand; PAM type: NRG; PAM sequence: TGG
gagacggggtttcaccatat

SEQ ID NO: 7994 - DNA, 20 bp, Artificial Sequence
  Description of Artificial Sequence: Synthetic oligonucleotide
  Target: ANGPTL3; (-) strand; PAM type: NRG; PAM sequence: GGG
ttgtattttaggtagagacg

SEQ ID NO: 7995 - DNA, 20 bp, Artificial Sequence
  Description of Artificial Sequence: Synthetic oligonucleotide
  Target: ANGPTL3; (-) strand; PAM type: NRG; PAM sequence: GGG
tttgtattttaggtagagac

SEQ ID NO: 7996 - DNA, 20 bp, Artificial Sequence
  Description of Artificial Sequence: Synthetic oligonucleotide
  Target: ANGPTL3; (-) strand; PAM type: NRG; PAM sequence: CGG
ttttgtattttaggtagaga

SEQ ID NO: 7997 - DNA, 20 bp, Artificial Sequence
  Description of Artificial Sequence: Synthetic oligonucleotide
  Target: ANGPTL3; (-) strand; PAM type: NRG; PAM sequence: GAG
taatttttgtattttaggta

SEQ ID NO: 7998 - DNA, 20 bp, Artificial Sequence
  Description of Artificial Sequence: Synthetic oligonucleotide
  Target: ANGPTL3; (-) strand; PAM type: NRG; PAM sequence: TAG
gctaatttttgtattttagg

SEQ ID NO: 7999 - DNA, 20 bp, Artificial Sequence
  Description of Artificial Sequence: Synthetic oligonucleotide
  Target: ANGPTL3; (-) strand; PAM type: NRG; PAM sequence: AGG
ctggctaatttttgtatttt

SEQ ID NO: 8000 - DNA, 20 bp, Artificial Sequence
  Description of Artificial Sequence: Synthetic oligonucleotide
  Target: ANGPTL3; (-) strand; PAM type: NRG; PAM sequence: TAG
cctggctaatttttgtattt

SEQ ID NO: 8001 - DNA, 20 bp, Artificial Sequence
  Description of Artificial Sequence: Synthetic oligonucleotide
  Target: ANGPTL3; (-) strand; PAM type: NRG; PAM sequence: TGG
taggcacatgccaccacgcc

SEQ ID NO: 8002 - DNA, 20 bp, Artificial Sequence
  Description of Artificial Sequence: Synthetic oligonucleotide
  Target: ANGPTL3; (-) strand; PAM type: NRG; PAM sequence: AGG
tcttgagtagctgggactgt

SEQ ID NO: 8003 - DNA, 20 bp, Artificial Sequence
  Description of Artificial Sequence: Synthetic oligonucleotide
  Target: ANGPTL3; (-) strand; PAM type: NRG; PAM sequence: TAG
ctcttgagtagctgggactg

SEQ ID NO: 8004 - DNA, 20 bp, Artificial Sequence
  Description of Artificial Sequence: Synthetic oligonucleotide
  Target: ANGPTL3; (-) strand; PAM type: NRG; PAM sequence: GGG
tctcagcctcttgagtagct

SEQ ID NO: 8005 - DNA, 20 bp, Artificial Sequence
  Description of Artificial Sequence: Synthetic oligonucleotide
  Target: ANGPTL3; (-) strand; PAM type: NRG; PAM sequence: TGG
gtctcagcctcttgagtagc

SEQ ID NO: 8006 - DNA, 20 bp, Artificial Sequence
  Description of Artificial Sequence: Synthetic oligonucleotide
  Target: ANGPTL3; (-) strand; PAM type: NRG; PAM sequence: TAG
tcctgtctcagcctcttgag

SEQ ID NO: 8007 - DNA, 20 bp, Artificial Sequence
  Description of Artificial Sequence: Synthetic oligonucleotide
  Target: ANGPTL3; (-) strand; PAM type: NRG; PAM sequence: GAG
ttctcctgtctcagcctctt

SEQ ID NO: 8008 - DNA, 20 bp, Artificial Sequence
  Description of Artificial Sequence: Synthetic oligonucleotide
  Target: ANGPTL3; (-) strand; PAM type: NRG; PAM sequence: CAG
ttcaagcgattctcctgtct

SEQ ID NO: 8009 - DNA, 20 bp, Artificial Sequence
  Description of Artificial Sequence: Synthetic oligonucleotide
  Target: ANGPTL3; (-) strand; PAM type: NRG; PAM sequence: AAG
aacctccgcctcctgggttc

SEQ ID NO: 8010 - DNA, 20 bp, Artificial Sequence
  Description of Artificial Sequence: Synthetic oligonucleotide
  Target: ANGPTL3; (-) strand; PAM type: NRG; PAM sequence: GGG
cactgcaacctccgcctcct

SEQ ID NO: 8011 - DNA, 20 bp, Artificial Sequence
  Description of Artificial Sequence: Synthetic oligonucleotide
  Target: ANGPTL3; (-) strand; PAM type: NRG; PAM sequence: TGG
tcactgcaacctccgcctcc

SEQ ID NO: 8012 - DNA, 20 bp, Artificial Sequence
  Description of Artificial Sequence: Synthetic oligonucleotide
  Target: ANGPTL3; (-) strand; PAM type: NRG; PAM sequence: CAG
ccagtgcattggtgtgatct

SEQ ID NO: 8013 - DNA, 20 bp, Artificial Sequence
  Description of Artificial Sequence: Synthetic oligonucleotide
  Target: ANGPTL3; (-) strand; PAM type: NRG; PAM sequence: TGG
tgttctgtcacccagtgcat

SEQ ID NO: 8014 - DNA, 20 bp, Artificial Sequence
  Description of Artificial Sequence: Synthetic oligonucleotide
  Target: ANGPTL3; (-) strand; PAM type: NRG; PAM sequence: CAG
gtcagtcttgttctgtcacc

SEQ ID NO: 8015 - DNA, 20 bp, Artificial Sequence
  Description of Artificial Sequence: Synthetic oligonucleotide
  Target: ANGPTL3; (-) strand; PAM type: NRG; PAM sequence: CAG
ttatttatttttttttgagt

SEQ ID NO: 8016 - DNA, 20 bp, Artificial Sequence
  Description of Artificial Sequence: Synthetic oligonucleotide
  Target: ANGPTL3; (-) strand; PAM type: NRG; PAM sequence: GAG
tttgttatttattttttttt

SEQ ID NO: 8017 - DNA, 20 bp, Artificial Sequence
  Description of Artificial Sequence: Synthetic oligonucleotide
  Target: ANGPTL3; (-) strand; PAM type: NRG; PAM sequence: GGG
gcagtagcagtaaggggctg

SEQ ID NO: 8018 - DNA, 20 bp, Artificial Sequence
  Description of Artificial Sequence: Synthetic oligonucleotide
  Target: ANGPTL3; (-) strand; PAM type: NRG; PAM sequence: GGG
agcagtagcagtaaggggct

SEQ ID NO: 8019 - DNA, 20 bp, Artificial Sequence
  Description of Artificial Sequence: Synthetic oligonucleotide
  Target: ANGPTL3; (-) strand; PAM type: NRG; PAM sequence: TGG
tagcagtagcagtaaggggc

SEQ ID NO: 8020 - DNA, 20 bp, Artificial Sequence
  Description of Artificial Sequence: Synthetic oligonucleotide
  Target: ANGPTL3; (-) strand; PAM type: NRG; PAM sequence: GGG
gggatagcagtagcagtaag

SEQ ID NO: 8021 - DNA, 20 bp, Artificial Sequence
  Description of Artificial Sequence: Synthetic oligonucleotide
  Target: ANGPTL3; (-) strand; PAM type: NRG; PAM sequence: GGG
agggatagcagtagcagtaa

SEQ ID NO: 8022 - DNA, 20 bp, Artificial Sequence
  Description of Artificial Sequence: Synthetic oligonucleotide
  Target: ANGPTL3; (-) strand; PAM type: NRG; PAM sequence: AGG
aagggatagcagtagcagta

SEQ ID NO: 8023 - DNA, 20 bp, Artificial Sequence
  Description of Artificial Sequence: Synthetic oligonucleotide
  Target: ANGPTL3; (-) strand; PAM type: NRG; PAM sequence: AAG
aaagggatagcagtagcagt

SEQ ID NO: 8024 - DNA, 20 bp, Artificial Sequence
  Description of Artificial Sequence: Synthetic oligonucleotide
  Target: ANGPTL3; (-) strand; PAM type: NRG; PAM sequence: CAG
gtagaaagggatagcagtag

SEQ ID NO: 8025 - DNA, 20 bp, Artificial Sequence
  Description of Artificial Sequence: Synthetic oligonucleotide
  Target: ANGPTL3; (-) strand; PAM type: NRG; PAM sequence: TAG
tgggtagaaagggatagcag

SEQ ID NO: 8026 - DNA, 20 bp, Artificial Sequence
  Description of Artificial Sequence: Synthetic oligonucleotide
  Target: ANGPTL3; (-) strand; PAM type: NRG; PAM sequence: CAG
aggtgggtagaaagggatag

SEQ ID NO: 8027 - DNA, 20 bp, Artificial Sequence
  Description of Artificial Sequence: Synthetic oligonucleotide
  Target: ANGPTL3; (-) strand; PAM type: NRG; PAM sequence: TAG
gaaaggtgggtagaaaggga

SEQ ID NO: 8028 - DNA, 20 bp, Artificial Sequence
  Description of Artificial Sequence: Synthetic oligonucleotide
  Target: ANGPTL3; (-) strand; PAM type: NRG; PAM sequence: GGG
gagggaaaggtgggtagaaa

SEQ ID NO: 8029 - DNA, 20 bp, Artificial Sequence
  Description of Artificial Sequence: Synthetic oligonucleotide
  Target: ANGPTL3; (-) strand; PAM type: NRG; PAM sequence: AGG
ggagggaaaggtgggtagaa

SEQ ID NO: 8030 - DNA, 20 bp, Artificial Sequence
  Description of Artificial Sequence: Synthetic oligonucleotide
  Target: ANGPTL3; (-) strand; PAM type: NRG; PAM sequence: AAG
aggagggaaaggtgggtaga

SEQ ID NO: 8031 - DNA, 20 bp, Artificial Sequence
  Description of Artificial Sequence: Synthetic oligonucleotide
  Target: ANGPTL3; (-) strand; PAM type: NRG; PAM sequence: TAG
ataaaggagggaaaggtggg

SEQ ID NO: 8032 - DNA, 20 bp, Artificial Sequence
  Description of Artificial Sequence: Synthetic oligonucleotide
  Target: ANGPTL3; (-) strand; PAM type: NRG; PAM sequence: GGG
agtataaaggagggaaaggt

SEQ ID NO: 8033 - DNA, 20 bp, Artificial Sequence
  Description of Artificial Sequence: Synthetic oligonucleotide
  Target: ANGPTL3; (-) strand; PAM type: NRG; PAM sequence: TGG
gagtataaaggagggaaagg

SEQ ID NO: 8034 - DNA, 20 bp, Artificial Sequence
  Description of Artificial Sequence: Synthetic oligonucleotide
  Target: ANGPTL3; (-) strand; PAM type: NRG; PAM sequence: AGG
aaagagtataaaggagggaa

SEQ ID NO: 8035 - DNA, 20 bp, Artificial Sequence
  Description of Artificial Sequence: Synthetic oligonucleotide
  Target: ANGPTL3; (-) strand; PAM type: NRG; PAM sequence: AAG
gaaagagtataaaggaggga

SEQ ID NO: 8036 - DNA, 20 bp, Artificial Sequence
  Description of Artificial Sequence: Synthetic oligonucleotide
  Target: ANGPTL3; (-) strand; PAM type: NRG; PAM sequence: GGG
gtgtgaaagagtataaagga

SEQ ID NO: 8037 - DNA, 20 bp, Artificial Sequence
  Description of Artificial Sequence: Synthetic oligonucleotide
  Target: ANGPTL3; (-) strand; PAM type: NRG; PAM sequence: AGG
ggtgtgaaagagtataaagg

SEQ ID NO: 8038 - DNA, 20 bp, Artificial Sequence
  Description of Artificial Sequence: Synthetic oligonucleotide
  Target: ANGPTL3; (-) strand; PAM type: NRG; PAM sequence: GAG
tggtgtgaaagagtataaag

SEQ ID NO: 8039 - DNA, 20 bp, Artificial Sequence
  Description of Artificial Sequence: Synthetic oligonucleotide
  Target: ANGPTL3; (-) strand; PAM type: NRG; PAM sequence: AGG
gatggtgtgaaagagtataa

SEQ ID NO: 8040 - DNA, 20 bp, Artificial Sequence
  Description of Artificial Sequence: Synthetic oligonucleotide
  Target: ANGPTL3; (-) strand; PAM type: NRG; PAM sequence: AAG
agatggtgtgaaagagtata

SEQ ID NO: 8041 - DNA, 20 bp, Artificial Sequence
  Description of Artificial Sequence: Synthetic oligonucleotide
  Target: ANGPTL3; (-) strand; PAM type: NRG; PAM sequence: GAG
gtgaggaagatggtgtgaaa

SEQ ID NO: 8042 - DNA, 20 bp, Artificial Sequence
  Description of Artificial Sequence: Synthetic oligonucleotide
  Target: ANGPTL3; (-) strand; PAM type: NRG; PAM sequence: AAG
aagtgaggaagatggtgtga

SEQ ID NO: 8043 - DNA, 20 bp, Artificial Sequence
  Description of Artificial Sequence: Synthetic oligonucleotide
  Target: ANGPTL3; (-) strand; PAM type: NRG; PAM sequence: TGG
atataaagaagtgaggaaga

SEQ ID NO: 8044 - DNA, 20 bp, Artificial Sequence
  Description of Artificial Sequence: Synthetic oligonucleotide
  Target: ANGPTL3; (-) strand; PAM type: NRG; PAM sequence: AAG
atggatataaagaagtgagg

SEQ ID NO: 8045 - DNA, 20 bp, Artificial Sequence
  Description of Artificial Sequence: Synthetic oligonucleotide
  Target: ANGPTL3; (-) strand; PAM type: NRG; PAM sequence: AGG
ttaatggatataaagaagtg

SEQ ID NO: 8046 - DNA, 20 bp, Artificial Sequence
  Description of Artificial Sequence: Synthetic oligonucleotide
  Target: ANGPTL3; (-) strand; PAM type: NRG; PAM sequence: GAG
attaatggatataaagaagt

SEQ ID NO: 8047 - DNA, 20 bp, Artificial Sequence
  Description of Artificial Sequence: Synthetic oligonucleotide
  Target: ANGPTL3; (-) strand; PAM type: NRG; PAM sequence: AAG
tcatattaatggatataaag

SEQ ID NO: 8048 - DNA, 20 bp, Artificial Sequence
  Description of Artificial Sequence: Synthetic oligonucleotide
  Target: ANGPTL3; (-) strand; PAM type: NRG; PAM sequence: AAG
tggtcatattaatggatata

SEQ ID NO: 8049 - DNA, 20 bp, Artificial Sequence
  Description of Artificial Sequence: Synthetic oligonucleotide
  Target: ANGPTL3; (-) strand; PAM type: NRG; PAM sequence: TGG
gaacatgctggtcatattaa

SEQ ID NO: 8050 - DNA, 20 bp, Artificial Sequence
  Description of Artificial Sequence: Synthetic oligonucleotide
  Target: ANGPTL3; (-) strand; PAM type: NRG; PAM sequence: TGG
ttctgtgactgggaacatgc

SEQ ID NO: 8051 - DNA, 20 bp, Artificial Sequence
  Description of Artificial Sequence: Synthetic oligonucleotide
  Target: ANGPTL3; (-) strand; PAM type: NRG; PAM sequence: GGG
ggttccaggcttctgtgact

SEQ ID NO: 8052 - DNA, 20 bp, Artificial Sequence
  Description of Artificial Sequence: Synthetic oligonucleotide
  Target: ANGPTL3; (-) strand; PAM type: NRG; PAM sequence: TGG
gggttccaggcttctgtgac

SEQ ID NO: 8053 - DNA, 20 bp, Artificial Sequence
  Description of Artificial Sequence: Synthetic oligonucleotide
  Target: ANGPTL3; (-) strand; PAM type: NRG; PAM sequence: AGG
agagatgtcttccgggttcc

SEQ ID NO: 8054 - DNA, 20 bp, Artificial Sequence
  Description of Artificial Sequence: Synthetic oligonucleotide
  Target: ANGPTL3; (-) strand; PAM type: NRG; PAM sequence: CAG
cagagatgtcttccgggttc

SEQ ID NO: 8055 - DNA, 20 bp, Artificial Sequence
  Description of Artificial Sequence: Synthetic oligonucleotide
  Target: ANGPTL3; (-) strand; PAM type: NRG; PAM sequence: GGG
aaaagccagagatgtcttcc

SEQ ID NO: 8056 - DNA, 20 bp, Artificial Sequence
  Description of Artificial Sequence: Synthetic oligonucleotide
  Target: ANGPTL3; (-) strand; PAM type: NRG; PAM sequence: CGG
gaaaagccagagatgtcttc

SEQ ID NO: 8057 - DNA, 20 bp, Artificial Sequence
  Description of Artificial Sequence: Synthetic oligonucleotide
  Target: ANGPTL3; (-) strand; PAM type: NRG; PAM sequence: GAG
caaagttgagtgaaaagcca

SEQ ID NO: 8058 - DNA, 20 bp, Artificial Sequence
  Description of Artificial Sequence: Synthetic oligonucleotide
  Target: ANGPTL3; (-) strand; PAM type: NRG; PAM sequence: CAG
tacaaagttgagtgaaaagc

SEQ ID NO: 8059 - DNA, 20 bp, Artificial Sequence
  Description of Artificial Sequence: Synthetic oligonucleotide
  Target: ANGPTL3; (-) strand; PAM type: NRG; PAM sequence: AAG
agtttacaaagttgagtgaa

SEQ ID NO: 8060 - DNA, 20 bp, Artificial Sequence
  Description of Artificial Sequence: Synthetic oligonucleotide
  Target: ANGPTL3; (-) strand; PAM type: NRG; PAM sequence: GAG
aagaggtagtttacaaagtt

SEQ ID NO: 8061 - DNA, 20 bp, Artificial Sequence
  Description of Artificial Sequence: Synthetic oligonucleotide
  Target: ANGPTL3; (-) strand; PAM type: NRG; PAM sequence: AAG
tacaaaagaggtagtttaca

SEQ ID NO: 8062 - DNA, 20 bp, Artificial Sequence
  Description of Artificial Sequence: Synthetic oligonucleotide
  Target: ANGPTL3; (-) strand; PAM type: NRG; PAM sequence: TAG
ggcttatgatacaaaagagg

SEQ ID NO: 8063 - DNA, 20 bp, Artificial Sequence
  Description of Artificial Sequence: Synthetic oligonucleotide
  Target: ANGPTL3; (-) strand; PAM type: NRG; PAM sequence: AGG
ggtggcttatgatacaaaag

SEQ ID NO: 8064 - DNA, 20 bp, Artificial Sequence
  Description of Artificial Sequence: Synthetic oligonucleotide
  Target: ANGPTL3; (-) strand; PAM type: NRG; PAM sequence: GAG
tggtggcttatgatacaaaa

SEQ ID NO: 8065 - DNA, 20 bp, Artificial Sequence
  Description of Artificial Sequence: Synthetic oligonucleotide
  Target: ANGPTL3; (-) strand; PAM type: NRG; PAM sequence: AAG
cttggtggcttatgatacaa

SEQ ID NO: 8066 - DNA, 20 bp, Artificial Sequence
  Description of Artificial Sequence: Synthetic oligonucleotide
  Target: ANGPTL3; (-) strand; PAM type: NRG; PAM sequence: TGG
gaagattgtattgaacttgg

SEQ ID NO: 8067 - DNA, 20 bp, Artificial Sequence
  Description of Artificial Sequence: Synthetic oligonucleotide
  Target: ANGPTL3; (-) strand; PAM type: NRG; PAM sequence: TGG
agagaagattgtattgaact

SEQ ID NO: 8068 - DNA, 20 bp, Artificial Sequence
  Description of Artificial Sequence: Synthetic oligonucleotide
  Target: ANGPTL3; (-) strand; PAM type: NRG; PAM sequence: AAG
attaagagacgtttcaagag

SEQ ID NO: 8069 - DNA, 20 bp, Artificial Sequence
  Description of Artificial Sequence: Synthetic oligonucleotide
  Target: ANGPTL3; (-) strand; PAM type: NRG; PAM sequence: GAG
aagattaagagacgtttcaa

SEQ ID NO: 8070 - DNA, 20 bp, Artificial Sequence
  Description of Artificial Sequence: Synthetic oligonucleotide
  Target: ANGPTL3; (-) strand; PAM type: NRG; PAM sequence: AAG
ataagattaagagacgtttc

SEQ ID NO: 8071 - DNA, 20 bp, Artificial Sequence
  Description of Artificial Sequence: Synthetic oligonucleotide
  Target: ANGPTL3; (-) strand; PAM type: NRG; PAM sequence: GAG
aagaaagcttataagattaa

SEQ ID NO: 8072 - DNA, 20 bp, Artificial Sequence
  Description of Artificial Sequence: Synthetic oligonucleotide
  Target: ANGPTL3; (-) strand; PAM type: NRG; PAM sequence: AAG
ggaagaaagcttataagatt

SEQ ID NO: 8073 - DNA, 20 bp, Artificial Sequence
  Description of Artificial Sequence: Synthetic oligonucleotide
  Target: ANGPTL3; (-) strand; PAM type: NRG; PAM sequence: AAG
ctttggggaagaaagcttat

SEQ ID NO: 8074 - DNA, 20 bp, Artificial Sequence
  Description of Artificial Sequence: Synthetic oligonucleotide
  Target: ANGPTL3; (-) strand; PAM type: NRG; PAM sequence: AAG
aagacagtctttggggaaga

SEQ ID NO: 8075 - DNA, 20 bp, Artificial Sequence
  Description of Artificial Sequence: Synthetic oligonucleotide
  Target: ANGPTL3; (-) strand; PAM type: NRG; PAM sequence: AAG
gttaaagacagtctttgggg

SEQ ID NO: 8076 - DNA, 20 bp, Artificial Sequence
  Description of Artificial Sequence: Synthetic oligonucleotide
  Target: ANGPTL3; (-) strand; PAM type: NRG; PAM sequence: GGG
gaagttaaagacagtctttg

SEQ ID NO: 8077 - DNA, 20 bp, Artificial Sequence
  Description of Artificial Sequence: Synthetic oligonucleotide
  Target: ANGPTL3; (-) strand; PAM type: NRG; PAM sequence: GGG
tgaagttaaagacagtcttt

SEQ ID NO: 8078 - DNA, 20 bp, Artificial Sequence
  Description of Artificial Sequence: Synthetic oligonucleotide
  Target: ANGPTL3; (-) strand; PAM type: NRG; PAM sequence: TGG
ctgaagttaaagacagtctt

SEQ ID NO: 8079 - DNA, 20 bp, Artificial Sequence
  Description of Artificial Sequence: Synthetic oligonucleotide
  Target: ANGPTL3; (-) strand; PAM type: NRG; PAM sequence: CAG
tctagcactgaagttaaaga

SEQ ID NO: 8080 - DNA, 20 bp, Artificial Sequence
  Description of Artificial Sequence: Synthetic oligonucleotide
  Target: ANGPTL3; (-) strand; PAM type: NRG; PAM sequence: AAG
ataatctagcactgaagtta

SEQ ID NO: 8081 - DNA, 20 bp, Artificial Sequence
  Description of Artificial Sequence: Synthetic oligonucleotide
  Target: ANGPTL3; (-) strand; PAM type: NRG; PAM sequence: AAG
acttatataatctagcactg

SEQ ID NO: 8082 - DNA, 20 bp, Artificial Sequence
  Description of Artificial Sequence: Synthetic oligonucleotide
  Target: ANGPTL3; (-) strand; PAM type: NRG; PAM sequence: TAG
aagagactacttatataatc

SEQ ID NO: 8083 - DNA, 20 bp, Artificial Sequence
  Description of Artificial Sequence: Synthetic oligonucleotide
  Target: ANGPTL3; (-) strand; PAM type: NRG; PAM sequence: GAG
gtaaaattaggaggaaagaa

SEQ ID NO: 8084 - DNA, 20 bp, Artificial Sequence
  Description of Artificial Sequence: Synthetic oligonucleotide
  Target: ANGPTL3; (-) strand; PAM type: NRG; PAM sequence: AAG
acgtaaaattaggaggaaag

SEQ ID NO: 8085 - DNA, 20 bp, Artificial Sequence
  Description of Artificial Sequence: Synthetic oligonucleotide
  Target: ANGPTL3; (-) strand; PAM type: NRG; PAM sequence: AAG
gggacgtaaaattaggagga

SEQ ID NO: 8086 - DNA, 20 bp, Artificial Sequence
  Description of Artificial Sequence: Synthetic oligonucleotide
  Target: ANGPTL3; (-) strand; PAM type: NRG; PAM sequence: AGG
gagagggacgtaaaattagg

SEQ ID NO: 8087 - DNA, 20 bp, Artificial Sequence
  Description of Artificial Sequence: Synthetic oligonucleotide
  Target: ANGPTL3; (-) strand; PAM type: NRG; PAM sequence: GAG
ggagagggacgtaaaattag

SEQ ID NO: 8088 - DNA, 20 bp, Artificial Sequence
  Description of Artificial Sequence: Synthetic oligonucleotide
  Target: ANGPTL3; (-) strand; PAM type: NRG; PAM sequence: AGG
agggagagggacgtaaaatt

SEQ ID NO: 8089 - DNA, 20 bp, Artificial Sequence
  Description of Artificial Sequence: Synthetic oligonucleotide
  Target: ANGPTL3; (-) strand; PAM type: NRG; PAM sequence: TAG
cagggagagggacgtaaaat

SEQ ID NO: 8090 - DNA, 20 bp, Artificial Sequence
  Description of Artificial Sequence: Synthetic oligonucleotide
  Target: ANGPTL3; (-) strand; PAM type: NRG; PAM sequence: GGG
tcggaagattgacagggaga

SEQ ID NO: 8091 - DNA, 20 bp, Artificial Sequence
  Description of Artificial Sequence: Synthetic oligonucleotide
  Target: ANGPTL3; (-) strand; PAM type: NRG; PAM sequence: AGG
ttcggaagattgacagggag

SEQ ID NO: 8092 - DNA, 20 bp, Artificial Sequence
  Description of Artificial Sequence: Synthetic oligonucleotide
  Target: ANGPTL3; (-) strand; PAM type: NRG; PAM sequence: GAG
tttcggaagattgacaggga

SEQ ID NO: 8093 - DNA, 20 bp, Artificial Sequence
  Description of Artificial Sequence: Synthetic oligonucleotide
  Target: ANGPTL3; (-) strand; PAM type: NRG; PAM sequence: GAG
cttttcggaagattgacagg

SEQ ID NO: 8094 - DNA, 20 bp, Artificial Sequence
  Description of Artificial Sequence: Synthetic oligonucleotide
  Target: ANGPTL3; (-) strand; PAM type: NRG; PAM sequence: GGG
tccttttcggaagattgaca

SEQ ID NO: 8095 - DNA, 20 bp, Artificial Sequence
  Description of Artificial Sequence: Synthetic oligonucleotide
  Target: ANGPTL3; (-) strand; PAM type: NRG; PAM sequence: AGG
ttccttttcggaagattgac

SEQ ID NO: 8096 - DNA, 20 bp, Artificial Sequence
  Description of Artificial Sequence: Synthetic oligonucleotide
  Target: ANGPTL3; (-) strand; PAM type: NRG; PAM sequence: CAG
attccttttcggaagattga

SEQ ID NO: 8097 - DNA, 20 bp, Artificial Sequence
  Description of Artificial Sequence: Synthetic oligonucleotide
  Target: ANGPTL3; (-) strand; PAM type: NRG; PAM sequence: AAG
cattacaaattccttttcgg

SEQ ID NO: 8098 - DNA, 20 bp, Artificial Sequence
  Description of Artificial Sequence: Synthetic oligonucleotide
  Target: ANGPTL3; (-) strand; PAM type: NRG; PAM sequence: CGG
agccattacaaattcctttt

SEQ ID NO: 8099 - DNA, 20 bp, Artificial Sequence
  Description of Artificial Sequence: Synthetic oligonucleotide
  Target: ANGPTL3; (-) strand; PAM type: NRG; PAM sequence: CAG
acacaggtccaggcagtatg

SEQ ID NO: 8100 - DNA, 20 bp, Artificial Sequence
  Description of Artificial Sequence: Synthetic oligonucleotide
  Target: ANGPTL3; (-) strand; PAM type: NRG; PAM sequence: CAG
ttgaaagacacaggtccagg

SEQ ID NO: 8101 - DNA, 20 bp, Artificial Sequence
  Description of Artificial Sequence: Synthetic oligonucleotide
  Target: ANGPTL3; (-) strand; PAM type: NRG; PAM sequence: AGG
agcttgaaagacacaggtcc

SEQ ID NO: 8102 - DNA, 20 bp, Artificial Sequence
  Description of Artificial Sequence: Synthetic oligonucleotide
  Target: ANGPTL3; (-) strand; PAM type: NRG; PAM sequence: CAG
gagcttgaaagacacaggtc

SEQ ID NO: 8103 - DNA, 20 bp, Artificial Sequence
  Description of Artificial Sequence: Synthetic oligonucleotide
  Target: ANGPTL3; (-) strand; PAM type: NRG; PAM sequence: AGG
tagatgagcttgaaagacac

SEQ ID NO: 8104 - DNA, 20 bp, Artificial Sequence
  Description of Artificial Sequence: Synthetic oligonucleotide
  Target: ANGPTL3; (-) strand; PAM type: NRG; PAM sequence: CAG
gtagatgagcttgaaagaca

SEQ ID NO: 8105 - DNA, 20 bp, Artificial Sequence
  Description of Artificial Sequence: Synthetic oligonucleotide
  Target: ANGPTL3; (-) strand; PAM type: NRG; PAM sequence: AAG
tcttcagtagatgagcttga

SEQ ID NO: 8106 - DNA, 20 bp, Artificial Sequence
  Description of Artificial Sequence: Synthetic oligonucleotide
  Target: ANGPTL3; (-) strand; PAM type: NRG; PAM sequence: GAG
gttacacttcttcagtagat

SEQ ID NO: 8107 - DNA, 20 bp, Artificial Sequence
  Description of Artificial Sequence: Synthetic oligonucleotide
  Target: ANGPTL3; (-) strand; PAM type: NRG; PAM sequence: TAG
ctgctgttacacttcttcag

SEQ ID NO: 8108 - DNA, 20 bp, Artificial Sequence
  Description of Artificial Sequence: Synthetic oligonucleotide
  Target: ANGPTL3; (-) strand; PAM type: NRG; PAM sequence: CAG
cctctgctgttacacttctt

SEQ ID NO: 8109 - DNA, 20 bp, Artificial Sequence
  Description of Artificial Sequence: Synthetic oligonucleotide
  Target: ANGPTL3; (-) strand; PAM type: NRG; PAM sequence: AGG
ctgtaactccagacaataaa

SEQ ID NO: 8110 - DNA, 20 bp, Artificial Sequence
  Description of Artificial Sequence: Synthetic oligonucleotide
  Target: ANGPTL3; (-) strand; PAM type: NRG; PAM sequence: AAG
cctgtaactccagacaataa

SEQ ID NO: 8111 - DNA, 20 bp, Artificial Sequence
  Description of Artificial Sequence: Synthetic oligonucleotide
  Target: ANGPTL3; (-) strand; PAM type: NRG; PAM sequence: CAG
gttattttatcctgtaactc

SEQ ID NO: 8112 - DNA, 20 bp, Artificial Sequence
  Description of Artificial Sequence: Synthetic oligonucleotide
  Target: ANGPTL3; (-) strand; PAM type: NRG; PAM sequence: AAG
aagaaatttgtgcatatagt

SEQ ID NO: 8113 - DNA, 20 bp, Artificial Sequence
  Description of Artificial Sequence: Synthetic oligonucleotide
  Target: ANGPTL3; (-) strand; PAM type: NRG; PAM sequence: TAG
ctgaaagaaatttgtgcata

SEQ ID NO: 8114 - DNA, 20 bp, Artificial Sequence
  Description of Artificial Sequence: Synthetic oligonucleotide
  Target: ANGPTL3; (-) strand; PAM type: NRG; PAM sequence: AAG
agatcccaataagattctga

SEQ ID NO: 8115 - DNA, 20 bp, Artificial Sequence
  Description of Artificial Sequence: Synthetic oligonucleotide
  Target: ANGPTL3; (-) strand; PAM type: NRG; PAM sequence: AAG
atttaagctaagatcccaat

SEQ ID NO: 8116 - DNA, 20 bp, Artificial Sequence
  Description of Artificial Sequence: Synthetic oligonucleotide
  Target: ANGPTL3; (-) strand; PAM type: NRG; PAM sequence: AAG
aaaattctaagatttaagct

SEQ ID NO: 8117 - DNA, 20 bp, Artificial Sequence
  Description of Artificial Sequence: Synthetic oligonucleotide
  Target: ANGPTL3; (-) strand; PAM type: NRG; PAM sequence: AAG
aaagtaaaattctaagattt

SEQ ID NO: 8118 - DNA, 20 bp, Artificial Sequence
  Description of Artificial Sequence: Synthetic oligonucleotide
  Target: ANGPTL3; (-) strand; PAM type: NRG; PAM sequence: AAG
caattttaaagtaaaattct

SEQ ID NO: 8119 - DNA, 20 bp, Artificial Sequence
  Description of Artificial Sequence: Synthetic oligonucleotide
  Target: ANGPTL3; (-) strand; PAM type: NRG; PAM sequence: AAG
acaattcatatgcaatttta

SEQ ID NO: 8120 - DNA, 20 bp, Artificial Sequence
  Description of Artificial Sequence: Synthetic oligonucleotide
  Target: ANGPTL3; (-) strand; PAM type: NRG; PAM sequence: AAG
ggcatgaagatagatttata

SEQ ID NO: 8121 - DNA, 20 bp, Artificial Sequence
  Description of Artificial Sequence: Synthetic oligonucleotide
  Target: ANGPTL3; (-) strand; PAM type: NRG; PAM sequence: TAG
agccactgcaggcatgaaga

SEQ ID NO: 8122 - DNA, 20 bp, Artificial Sequence
  Description of Artificial Sequence: Synthetic oligonucleotide
  Target: ANGPTL3; (-) strand; PAM type: NRG; PAM sequence: AAG
tgtgagccactgcaggcatg

SEQ ID NO: 8123 - DNA, 20 bp, Artificial Sequence
  Description of Artificial Sequence: Synthetic oligonucleotide
  Target: ANGPTL3; (-) strand; PAM type: NRG; PAM sequence: AGG
ttacaggtgtgagccactgc

SEQ ID NO: 8124 - DNA, 20 bp, Artificial Sequence
  Description of Artificial Sequence: Synthetic oligonucleotide
  Target: ANGPTL3; (-) strand; PAM type: NRG; PAM sequence: CAG
attacaggtgtgagccactg

SEQ ID NO: 8125 - DNA, 20 bp, Artificial Sequence
  Description of Artificial Sequence: Synthetic oligonucleotide
  Target: ANGPTL3; (-) strand; PAM type: NRG; PAM sequence: GAG
aatacttggattacaggtgt

SEQ ID NO: 8126 - DNA, 20 bp, Artificial Sequence
  Description of Artificial Sequence: Synthetic oligonucleotide
  Target: ANGPTL3; (-) strand; PAM type: NRG; PAM sequence: AGG
tcccaaaatacttggattac

SEQ ID NO: 8127 - DNA, 20 bp, Artificial Sequence
  Description of Artificial Sequence: Synthetic oligonucleotide
  Target: ANGPTL3; (-) strand; PAM type: NRG; PAM sequence: CAG
ctcccaaaatacttggatta

SEQ ID NO: 8128 - DNA, 20 bp, Artificial Sequence
  Description of Artificial Sequence: Synthetic oligonucleotide
  Target: ANGPTL3; (-) strand; PAM type: NRG; PAM sequence: TGG
ccccggcctcccaaaatact

SEQ ID NO: 8129 - DNA, 20 bp, Artificial Sequence
  Description of Artificial Sequence: Synthetic oligonucleotide
  Target: ANGPTL3; (-) strand; PAM type: NRG; PAM sequence: CGG
ttcaagcagtactcccgccc

SEQ ID NO: 8130 - DNA, 20 bp, Artificial Sequence
  Description of Artificial Sequence: Synthetic oligonucleotide
  Target: ANGPTL3; (-) strand; PAM type: NRG; PAM sequence: CAG
cttggactcctgggttcaag

SEQ ID NO: 8131 - DNA, 20 bp, Artificial Sequence
  Description of Artificial Sequence: Synthetic oligonucleotide
  Target: ANGPTL3; (-) strand; PAM type: NRG; PAM sequence: AAG
gatcttggactcctgggttc

SEQ ID NO: 8132 - DNA, 20 bp, Artificial Sequence
  Description of Artificial Sequence: Synthetic oligonucleotide
  Target: ANGPTL3; (-) strand; PAM type: NRG; PAM sequence: GGG
caggctgatcttggactcct

SEQ ID NO: 8133 - DNA, 20 bp, Artificial Sequence
  Description of Artificial Sequence: Synthetic oligonucleotide
  Target: ANGPTL3; (-) strand; PAM type: NRG; PAM sequence: TGG
acaggctgatcttggactcc

SEQ ID NO: 8134 - DNA, 20 bp, Artificial Sequence
  Description of Artificial Sequence: Synthetic oligonucleotide
  Target: ANGPTL3; (-) strand; PAM type: NRG; PAM sequence: TGG
cgtgttgcacaggctgatct

SEQ ID NO: 8135 - DNA, 20 bp, Artificial Sequence
  Description of Artificial Sequence: Synthetic oligonucleotide
  Target: ANGPTL3; (-) strand; PAM type: NRG; PAM sequence: AGG
ggagttttgccgtgttgcac

SEQ ID NO: 8136 - DNA, 20 bp, Artificial Sequence
  Description of Artificial Sequence: Synthetic oligonucleotide
  Target: ANGPTL3; (-) strand; PAM type: NRG; PAM sequence: CAG
tggagttttgccgtgttgca

SEQ ID NO: 8137 - DNA, 20 bp, Artificial Sequence
  Description of Artificial Sequence: Synthetic oligonucleotide
  Target: ANGPTL3; (-) strand; PAM type: NRG; PAM sequence: GAG
ttgtattttttgtagaggtg

SEQ ID NO: 8138 - DNA, 20 bp, Artificial Sequence
  Description of Artificial Sequence: Synthetic oligonucleotide
  Target: ANGPTL3; (-) strand; PAM type: NRG; PAM sequence: TGG
ttttgtattttttgtagagg

SEQ ID NO: 8139 - DNA, 20 bp, Artificial Sequence
  Description of Artificial Sequence: Synthetic oligonucleotide
  Target: ANGPTL3; (-) strand; PAM type: NRG; PAM sequence: AGG
aatttttgtattttttgtag

SEQ ID NO: 8140 - DNA, 20 bp, Artificial Sequence
  Description of Artificial Sequence: Synthetic oligonucleotide
  Target: ANGPTL3; (-) strand; PAM type: NRG; PAM sequence: GAG
taatttttgtattttttgta

SEQ ID NO: 8141 - DNA, 20 bp, Artificial Sequence
  Description of Artificial Sequence: Synthetic oligonucleotide
  Target: ANGPTL3; (-) strand; PAM type: NRG; PAM sequence: TAG
gctaatttttgtattttttg

SEQ ID NO: 8142 - DNA, 20 bp, Artificial Sequence
  Description of Artificial Sequence: Synthetic oligonucleotide
  Target: ANGPTL3; (-) strand; PAM type: NRG; PAM sequence: CAG
caggcacctgccaccacacc

SEQ ID NO: 8143 - DNA, 20 bp, Artificial Sequence
  Description of Artificial Sequence: Synthetic oligonucleotide
  Target: ANGPTL3; (-) strand; PAM type: NRG; PAM sequence: AGG
tcccaagtagttgggattac

SEQ ID NO: 8144 - DNA, 20 bp, Artificial Sequence
  Description of Artificial Sequence: Synthetic oligonucleotide
  Target: ANGPTL3; (-) strand; PAM type: NRG; PAM sequence: CAG
ctcccaagtagttgggatta

SEQ ID NO: 8145 - DNA, 20 bp, Artificial Sequence
  Description of Artificial Sequence: Synthetic oligonucleotide
  Target: ANGPTL3; (-) strand; PAM type: NRG; PAM sequence: GGG
cctcagcctcccaagtagtt

SEQ ID NO: 8146 - DNA, 20 bp, Artificial Sequence
  Description of Artificial Sequence: Synthetic oligonucleotide
  Target: ANGPTL3; (-) strand; PAM type: NRG; PAM sequence: TGG
gcctcagcctcccaagtagt

SEQ ID NO: 8147 - DNA, 20 bp, Artificial Sequence
  Description of Artificial Sequence: Synthetic oligonucleotide
  Target: ANGPTL3; (-) strand; PAM type: NRG; PAM sequence: TAG
tcctgcctcagcctcccaag

SEQ ID NO: 8148 - DNA, 20 bp, Artificial Sequence
  Description of Artificial Sequence: Synthetic oligonucleotide
  Target: ANGPTL3; (-) strand; PAM type: NRG; PAM sequence: AAG
ttctcctgcctcagcctccc

SEQ ID NO: 8149 - DNA, 20 bp, Artificial Sequence
  Description of Artificial Sequence: Synthetic oligonucleotide
  Target: ANGPTL3; (-) strand; PAM type: NRG; PAM sequence: CAG
ctccagcgattctcctgcct

SEQ ID NO: 8150 - DNA, 20 bp, Artificial Sequence
  Description of Artificial Sequence: Synthetic oligonucleotide
  Target: ANGPTL3; (-) strand; PAM type: NRG; PAM sequence: CAG
aggcttgacttcccaggctc

SEQ ID NO: 8151 - DNA, 20 bp, Artificial Sequence
  Description of Artificial Sequence: Synthetic oligonucleotide
  Target: ANGPTL3; (-) strand; PAM type: NRG; PAM sequence: AGG
cgctgcaggcttgacttccc

SEQ ID NO: 8152 - DNA, 20 bp, Artificial Sequence
  Description of Artificial Sequence: Synthetic oligonucleotide
  Target: ANGPTL3; (-) strand; PAM type: NRG; PAM sequence: CAG
tcgctgcaggcttgacttcc

SEQ ID NO: 8153 - DNA, 20 bp, Artificial Sequence
  Description of Artificial Sequence: Synthetic oligonucleotide
  Target: ANGPTL3; (-) strand; PAM type: NRG; PAM sequence: AGG
ttaggatcatggttcgctgc

SEQ ID NO: 8154 - DNA, 20 bp, Artificial Sequence
  Description of Artificial Sequence: Synthetic oligonucleotide
  Target: ANGPTL3; (-) strand; PAM type: NRG; PAM sequence: CAG
gttaggatcatggttcgctg

SEQ ID NO: 8155 - DNA, 20 bp, Artificial Sequence
  Description of Artificial Sequence: Synthetic oligonucleotide
  Target: ANGPTL3; (-) strand; PAM type: NRG; PAM sequence: TGG
agaatgcagtgttaggatca

SEQ ID NO: 8156 - DNA, 20 bp, Artificial Sequence
  Description of Artificial Sequence: Synthetic oligonucleotide
  Target: ANGPTL3; (-) strand; PAM type: NRG; PAM sequence: AGG
ccaggctagaatgcagtgtt

SEQ ID NO: 8157 - DNA, 20 bp, Artificial Sequence
  Description of Artificial Sequence: Synthetic oligonucleotide
  Target: ANGPTL3; (-) strand; PAM type: NRG; PAM sequence: TAG
cccaggctagaatgcagtgt

SEQ ID NO: 8158 - DNA, 20 bp, Artificial Sequence
  Description of Artificial Sequence: Synthetic oligonucleotide
  Target: ANGPTL3; (-) strand; PAM type: NRG; PAM sequence: CAG
ctgttgcccaggctagaatg

SEQ ID NO: 8159 - DNA, 20 bp, Artificial Sequence
  Description of Artificial Sequence: Synthetic oligonucleotide
  Target: ANGPTL3; (-) strand; PAM type: NRG; PAM sequence: TAG
tctcactctgttgcccaggc

SEQ ID NO: 8160 - DNA, 20 bp, Artificial Sequence
  Description of Artificial Sequence: Synthetic oligonucleotide
  Target: ANGPTL3; (-) strand; PAM type: NRG; PAM sequence: AGG
agagtctcactctgttgccc

SEQ ID NO: 8161 - DNA, 20 bp, Artificial Sequence
  Description of Artificial Sequence: Synthetic oligonucleotide
  Target: ANGPTL3; (-) strand; PAM type: NRG; PAM sequence: CAG
cagagtctcactctgttgcc

SEQ ID NO: 8162 - DNA, 20 bp, Artificial Sequence
  Description of Artificial Sequence: Synthetic oligonucleotide
  Target: ANGPTL3; (-) strand; PAM type: NRG; PAM sequence: GAG
tgaagattttttttgagaca

SEQ ID NO: 8163 - DNA, 20 bp, Artificial Sequence
  Description of Artificial Sequence: Synthetic oligonucleotide
  Target: ANGPTL3; (-) strand; PAM type: NRG; PAM sequence: CAG
tatgaagattttttttgaga

SEQ ID NO: 8164 - DNA, 20 bp, Artificial Sequence
  Description of Artificial Sequence: Synthetic oligonucleotide
  Target: ANGPTL3; (-) strand; PAM type: NRG; PAM sequence: GAG
tttatatgaagatttttttt

SEQ ID NO: 8165 - DNA, 20 bp, Artificial Sequence
  Description of Artificial Sequence: Synthetic oligonucleotide
  Target: ANGPTL3; (-) strand; PAM type: NRG; PAM sequence: AAG
gaaataaatatttttatatg

SEQ ID NO: 8166 - DNA, 20 bp, Artificial Sequence
  Description of Artificial Sequence: Synthetic oligonucleotide
  Target: ANGPTL3; (-) strand; PAM type: NRG; PAM sequence: GGG
tcactttttaaatacttggg

SEQ ID NO: 8167 - DNA, 20 bp, Artificial Sequence
  Description of Artificial Sequence: Synthetic oligonucleotide
  Target: ANGPTL3; (-) strand; PAM type: NRG; PAM sequence: GGG
atcactttttaaatacttgg

SEQ ID NO: 8168 - DNA, 20 bp, Artificial Sequence
  Description of Artificial Sequence: Synthetic oligonucleotide
  Target: ANGPTL3; (-) strand; PAM type: NRG; PAM sequence: GGG
catcactttttaaatacttg

SEQ ID NO: 8169 - DNA, 20 bp, Artificial Sequence
  Description of Artificial Sequence: Synthetic oligonucleotide
  Target: ANGPTL3; (-) strand; PAM type: NRG; PAM sequence: GGG
acatcactttttaaatactt

SEQ ID NO: 8170 - DNA, 20 bp, Artificial Sequence
  Description of Artificial Sequence: Synthetic oligonucleotide
  Target: ANGPTL3; (-) strand; PAM type: NRG; PAM sequence: TGG
aacatcactttttaaatact

SEQ ID NO: 8171 - DNA, 20 bp, Artificial Sequence
  Description of Artificial Sequence: Synthetic oligonucleotide
  Target: ANGPTL3; (-) strand; PAM type: NRG; PAM sequence: AGG
ataaacatgacacatcttct

SEQ ID NO: 8172 - DNA, 20 bp, Artificial Sequence
  Description of Artificial Sequence: Synthetic oligonucleotide
  Target: ANGPTL3; (-) strand; PAM type: NRG; PAM sequence: TAG
gataaacatgacacatcttc

SEQ ID NO: 8173 - DNA, 20 bp, Artificial Sequence
  Description of Artificial Sequence: Synthetic oligonucleotide
  Target: ANGPTL3; (-) strand; PAM type: NRG; PAM sequence: AGG
tatgggacgtgcaagttcac

SEQ ID NO: 8174 - DNA, 20 bp, Artificial Sequence
  Description of Artificial Sequence: Synthetic oligonucleotide
  Target: ANGPTL3; (-) strand; PAM type: NRG; PAM sequence: CAG
atatgggacgtgcaagttca

SEQ ID NO: 8175 - DNA, 20 bp, Artificial Sequence
  Description of Artificial Sequence: Synthetic oligonucleotide
  Target: ANGPTL3; (-) strand; PAM type: NRG; PAM sequence: AAG
cacaactatatgggacgtgc

SEQ ID NO: 8176 - DNA, 20 bp, Artificial Sequence
  Description of Artificial Sequence: Synthetic oligonucleotide
  Target: ANGPTL3; (-) strand; PAM type: NRG; PAM sequence: GGG
ttgtgagggcacaactatat

SEQ ID NO: 8177 - DNA, 20 bp, Artificial Sequence
  Description of Artificial Sequence: Synthetic oligonucleotide
  Target: ANGPTL3; (-) strand; PAM type: NRG; PAM sequence: TGG
cttgtgagggcacaactata

SEQ ID NO: 8178 - DNA, 20 bp, Artificial Sequence
  Description of Artificial Sequence: Synthetic oligonucleotide
  Target: ANGPTL3; (-) strand; PAM type: NRG; PAM sequence: GGG
tggagtatacattcttgtga

SEQ ID NO: 8179 - DNA, 20 bp, Artificial Sequence
  Description of Artificial Sequence: Synthetic oligonucleotide
  Target: ANGPTL3; (-) strand; PAM type: NRG; PAM sequence: AGG
ttggagtatacattcttgtg

SEQ ID NO: 8180 - DNA, 20 bp, Artificial Sequence
  Description of Artificial Sequence: Synthetic oligonucleotide
  Target: ANGPTL3; (-) strand; PAM type: NRG; PAM sequence: GAG
attggagtatacattcttgt

SEQ ID NO: 8181 - DNA, 20 bp, Artificial Sequence
  Description of Artificial Sequence: Synthetic oligonucleotide
  Target: ANGPTL3; (-) strand; PAM type: NRG; PAM sequence: GAG
ggcctatactcttctaattg

SEQ ID NO: 8182 - DNA, 20 bp, Artificial Sequence
  Description of Artificial Sequence: Synthetic oligonucleotide
  Target: ANGPTL3; (-) strand; PAM type: NRG; PAM sequence: TGG
aaggcctatactcttctaat

SEQ ID NO: 8183 - DNA, 20 bp, Artificial Sequence
  Description of Artificial Sequence: Synthetic oligonucleotide
  Target: ANGPTL3; (-) strand; PAM type: NRG; PAM sequence: AGG
gattttggattttgttccaa

SEQ ID NO: 8184 - DNA, 20 bp, Artificial Sequence
  Description of Artificial Sequence: Synthetic oligonucleotide
  Target: ANGPTL3; (-) strand; PAM type: NRG; PAM sequence: AAG
ggattttggattttgttcca

SEQ ID NO: 8185 - DNA, 20 bp, Artificial Sequence
  Description of Artificial Sequence: Synthetic oligonucleotide
  Target: ANGPTL3; (-) strand; PAM type: NRG; PAM sequence: TGG
ttgaaaacctggaaggattt

SEQ ID NO: 8186 - DNA, 20 bp, Artificial Sequence
  Description of Artificial Sequence: Synthetic oligonucleotide
  Target: ANGPTL3; (-) strand; PAM type: NRG; PAM sequence: AGG
gagacttttgaaaacctgga

SEQ ID NO: 8187 - DNA, 20 bp, Artificial Sequence
  Description of Artificial Sequence: Synthetic oligonucleotide
  Target: ANGPTL3; (-) strand; PAM type: NRG; PAM sequence: AAG
agagacttttgaaaacctgg

SEQ ID NO: 8188 - DNA, 20 bp, Artificial Sequence
  Description of Artificial Sequence: Synthetic oligonucleotide
  Target: ANGPTL3; (-) strand; PAM type: NRG; PAM sequence: TGG
gatagagacttttgaaaacc

SEQ ID NO: 8189 - DNA, 20 bp, Artificial Sequence
  Description of Artificial Sequence: Synthetic oligonucleotide
  Target: ANGPTL3; (-) strand; PAM type: NRG; PAM sequence: GAG
taatttggggccaggtgata

SEQ ID NO: 8190 - DNA, 20 bp, Artificial Sequence
  Description of Artificial Sequence: Synthetic oligonucleotide
  Target: ANGPTL3; (-) strand; PAM type: NRG; PAM sequence: TAG
ggtaatttggggccaggtga

SEQ ID NO: 8191 - DNA, 20 bp, Artificial Sequence
  Description of Artificial Sequence: Synthetic oligonucleotide
  Target: ANGPTL3; (-) strand; PAM type: NRG; PAM sequence: AGG
tgaagaggtaatttggggcc

SEQ ID NO: 8192 - DNA, 20 bp, Artificial Sequence
  Description of Artificial Sequence: Synthetic oligonucleotide
  Target: ANGPTL3; (-) strand; PAM type: NRG; PAM sequence: CAG
ctgaagaggtaatttggggc

SEQ ID NO: 8193 - DNA, 20 bp, Artificial Sequence
  Description of Artificial Sequence: Synthetic oligonucleotide
  Target: ANGPTL3; (-) strand; PAM type: NRG; PAM sequence: GGG
atggctgaagaggtaatttg

SEQ ID NO: 8194 - DNA, 20 bp, Artificial Sequence
  Description of Artificial Sequence: Synthetic oligonucleotide
  Target: ANGPTL3; (-) strand; PAM type: NRG; PAM sequence: GGG
aatggctgaagaggtaattt

SEQ ID NO: 8195 - DNA, 20 bp, Artificial Sequence
  Description of Artificial Sequence: Synthetic oligonucleotide
  Target: ANGPTL3; (-) strand; PAM type: NRG; PAM sequence: TGG
aaatggctgaagaggtaatt

SEQ ID NO: 8196 - DNA, 20 bp, Artificial Sequence
  Description of Artificial Sequence: Synthetic oligonucleotide
  Target: ANGPTL3; (-) strand; PAM type: NRG; PAM sequence: AGG
gtgggaaaaaatggctgaag

SEQ ID NO: 8197 - DNA, 20 bp, Artificial Sequence
  Description of Artificial Sequence: Synthetic oligonucleotide
  Target: ANGPTL3; (-) strand; PAM type: NRG; PAM sequence: GAG
tgtgggaaaaaatggctgaa

SEQ ID NO: 8198 - DNA, 20 bp, Artificial Sequence
  Description of Artificial Sequence: Synthetic oligonucleotide
  Target: ANGPTL3; (-) strand; PAM type: NRG; PAM sequence: AAG
gttgtgggaaaaaatggctg

SEQ ID NO: 8199 - DNA, 20 bp, Artificial Sequence
  Description of Artificial Sequence: Synthetic oligonucleotide
  Target: ANGPTL3; (-) strand; PAM type: NRG; PAM sequence: TGG
gtttgtgttgtgggaaaaaa

SEQ ID NO: 8200 - DNA, 20 bp, Artificial Sequence
  Description of Artificial Sequence: Synthetic oligonucleotide
  Target: ANGPTL3; (-) strand; PAM type: NRG; PAM sequence: GGG
gagcagaaggtttgtgttgt

SEQ ID NO: 8201 - DNA, 20 bp, Artificial Sequence
  Description of Artificial Sequence: Synthetic oligonucleotide
  Target: ANGPTL3; (-) strand; PAM type: NRG; PAM sequence: TGG
agagcagaaggtttgtgttg

SEQ ID NO: 8202 - DNA, 20 bp, Artificial Sequence
  Description of Artificial Sequence: Synthetic oligonucleotide
  Target: ANGPTL3; (-) strand; PAM type: NRG; PAM sequence: AGG
atcgttttgatgagagcaga

SEQ ID NO: 8203 - DNA, 20 bp, Artificial Sequence
  Description of Artificial Sequence: Synthetic oligonucleotide
  Target: ANGPTL3; (-) strand; PAM type: NRG; PAM sequence: AAG
gatcgttttgatgagagcag

SEQ ID NO: 8204 - DNA, 20 bp, Artificial Sequence
  Description of Artificial Sequence: Synthetic oligonucleotide
  Target: ANGPTL3; (-) strand; PAM type: NRG; PAM sequence: CAG
gtagatcgttttgatgagag

SEQ ID NO: 8205 - DNA, 20 bp, Artificial Sequence
  Description of Artificial Sequence: Synthetic oligonucleotide
  Target: ANGPTL3; (-) strand; PAM type: NRG; PAM sequence: GAG
aaagtagatcgttttgatga

SEQ ID NO: 8206 - DNA, 20 bp, Artificial Sequence
  Description of Artificial Sequence: Synthetic oligonucleotide
  Target: ANGPTL3; (-) strand; PAM type: NRG; PAM sequence: GAG
taaaagtagatcgttttgat

SEQ ID NO: 8207 - DNA, 20 bp, Artificial Sequence
  Description of Artificial Sequence: Synthetic oligonucleotide
  Target: ANGPTL3; (-) strand; PAM type: NRG; PAM sequence: TAG
atagaggagatgtttaaaag

SEQ ID NO: 8208 - DNA, 20 bp, Artificial Sequence
  Description of Artificial Sequence: Synthetic oligonucleotide
  Target: ANGPTL3; (-) strand; PAM type: NRG; PAM sequence: AAG
ggcatagaggagatgtttaa

SEQ ID NO: 8209 - DNA, 20 bp, Artificial Sequence
  Description of Artificial Sequence: Synthetic oligonucleotide
  Target: ANGPTL3; (-) strand; PAM type: NRG; PAM sequence: GAG
tacattaggaaggcatagag

SEQ ID NO: 8210 - DNA, 20 bp, Artificial Sequence
  Description of Artificial Sequence: Synthetic oligonucleotide
  Target: ANGPTL3; (-) strand; PAM type: NRG; PAM sequence: AGG
aatacattaggaaggcatag

SEQ ID NO: 8211 - DNA, 20 bp, Artificial Sequence
  Description of Artificial Sequence: Synthetic oligonucleotide
  Target: ANGPTL3; (-) strand; PAM type: NRG; PAM sequence: GAG
gaatacattaggaaggcata

SEQ ID NO: 8212 - DNA, 20 bp, Artificial Sequence
  Description of Artificial Sequence: Synthetic oligonucleotide
  Target: ANGPTL3; (-) strand; PAM type: NRG; PAM sequence: TAG
tggaatacattaggaaggca

SEQ ID NO: 8213 - DNA, 20 bp, Artificial Sequence
  Description of Artificial Sequence: Synthetic oligonucleotide
  Target: ANGPTL3; (-) strand; PAM type: NRG; PAM sequence: AGG
acaaatggaatacattagga

SEQ ID NO: 8214 - DNA, 20 bp, Artificial Sequence
  Description of Artificial Sequence: Synthetic oligonucleotide
  Target: ANGPTL3; (-) strand; PAM type: NRG; PAM sequence: AAG
gacaaatggaatacattagg

SEQ ID NO: 8215 - DNA, 20 bp, Artificial Sequence
  Description of Artificial Sequence: Synthetic oligonucleotide
  Target: ANGPTL3; (-) strand; PAM type: NRG; PAM sequence: AGG
ctagacaaatggaatacatt

SEQ ID NO: 8216 - DNA, 20 bp, Artificial Sequence
  Description of Artificial Sequence: Synthetic oligonucleotide
  Target: ANGPTL3; (-) strand; PAM type: NRG; PAM sequence: TAG
tctagacaaatggaatacat

SEQ ID NO: 8217 - DNA, 20 bp, Artificial Sequence
  Description of Artificial Sequence: Synthetic oligonucleotide
  Target: ANGPTL3; (-) strand; PAM type: NRG; PAM sequence: TGG
ggggagacattctagacaaa

SEQ ID NO: 8218 - DNA, 20 bp, Artificial Sequence
  Description of Artificial Sequence: Synthetic oligonucleotide
  Target: ANGPTL3; (-) strand; PAM type: NRG; PAM sequence: TAG
aaatgtgtggggagacattc

SEQ ID NO: 8219 - DNA, 20 bp, Artificial Sequence
  Description of Artificial Sequence: Synthetic oligonucleotide
  Target: ANGPTL3; (-) strand; PAM type: NRG; PAM sequence: GAG
gccaatcagaaatgtgtggg

SEQ ID NO: 8220 - DNA, 20 bp, Artificial Sequence
  Description of Artificial Sequence: Synthetic oligonucleotide
  Target: ANGPTL3; (-) strand; PAM type: NRG; PAM sequence: GGG
tagccaatcagaaatgtgtg

SEQ ID NO: 8221 - DNA, 20 bp, Artificial Sequence
  Description of Artificial Sequence: Synthetic oligonucleotide
  Target: ANGPTL3; (-) strand; PAM type: NRG; PAM sequence: GGG
ctagccaatcagaaatgtgt

SEQ ID NO: 8222 - DNA, 20 bp, Artificial Sequence
  Description of Artificial Sequence: Synthetic oligonucleotide
  Target: ANGPTL3; (-) strand; PAM type: NRG; PAM sequence: TGG
tctagccaatcagaaatgtg

SEQ ID NO: 8223 - DNA, 20 bp, Artificial Sequence
  Description of Artificial Sequence: Synthetic oligonucleotide
  Target: ANGPTL3; (-) strand; PAM type: NRG; PAM sequence: CAG
tacggcacaatctagccaat

SEQ ID NO: 8224 - DNA, 20 bp, Artificial Sequence
  Description of Artificial Sequence: Synthetic oligonucleotide
  Target: ANGPTL3; (-) strand; PAM type: NRG; PAM sequence: TAG
ccttaaaatacggcacaatc

SEQ ID NO: 8225 - DNA, 20 bp, Artificial Sequence
  Description of Artificial Sequence: Synthetic oligonucleotide
  Target: ANGPTL3; (-) strand; PAM type: NRG; PAM sequence: CGG
gatatctgcaccttaaaata

SEQ ID NO: 8226 - DNA, 20 bp, Artificial Sequence
  Description of Artificial Sequence: Synthetic oligonucleotide
  Target: ANGPTL3; (-) strand; PAM type: NRG; PAM sequence: GAG
agaatatttgtggaagaatt

SEQ ID NO: 8227 - DNA, 20 bp, Artificial Sequence
  Description of Artificial Sequence: Synthetic oligonucleotide
  Target: ANGPTL3; (-) strand; PAM type: NRG; PAM sequence: AAG
atttactagaatatttgtgg

SEQ ID NO: 8228 - DNA, 20 bp, Artificial Sequence
  Description of Artificial Sequence: Synthetic oligonucleotide
  Target: ANGPTL3; (-) strand; PAM type: NRG; PAM sequence: TGG
gccatttactagaatatttg

SEQ ID NO: 8229 - DNA, 20 bp, Artificial Sequence
  Description of Artificial Sequence: Synthetic oligonucleotide
  Target: ANGPTL3; (-) strand; PAM type: NRG; PAM sequence: TAG
atgaacaagctgccatttac

SEQ ID NO: 8230 - DNA, 20 bp, Artificial Sequence
  Description of Artificial Sequence: Synthetic oligonucleotide
  Target: ANGPTL3; (-) strand; PAM type: NRG; PAM sequence: AAG
ctgtgtggtttcagatgaac

SEQ ID NO: 8231 - DNA, 20 bp, Artificial Sequence
  Description of Artificial Sequence: Synthetic oligonucleotide
  Target: ANGPTL3; (-) strand; PAM type: NRG; PAM sequence: CAG
acagtaattctgtgtggttt

SEQ ID NO: 8232 - DNA, 20 bp, Artificial Sequence
  Description of Artificial Sequence: Synthetic oligonucleotide
  Target: ANGPTL3; (-) strand; PAM type: NRG; PAM sequence: TGG
gtatggacagtaattctgtg

SEQ ID NO: 8233 - DNA, 20 bp, Artificial Sequence
  Description of Artificial Sequence: Synthetic oligonucleotide
  Target: ANGPTL3; (-) strand; PAM type: NRG; PAM sequence: CAG
tgccatttgaggtgtatgga

SEQ ID NO: 8234 - DNA, 20 bp, Artificial Sequence
  Description of Artificial Sequence: Synthetic oligonucleotide
  Target: ANGPTL3; (-) strand; PAM type: NRG; PAM sequence: TGG
taagtgccatttgaggtgta

SEQ ID NO: 8235 - DNA, 20 bp, Artificial Sequence
  Description of Artificial Sequence: Synthetic oligonucleotide
  Target: ANGPTL3; (-) strand; PAM type: NRG; PAM sequence: AGG
ttctcactaagtgccatttg

SEQ ID NO: 8236 - DNA, 20 bp, Artificial Sequence
  Description of Artificial Sequence: Synthetic oligonucleotide
  Target: ANGPTL3; (-) strand; PAM type: NRG; PAM sequence: GAG
tttctcactaagtgccattt

SEQ ID NO: 8237 - DNA, 20 bp, Artificial Sequence
  Description of Artificial Sequence: Synthetic oligonucleotide
  Target: ANGPTL3; (-) strand; PAM type: NRG; PAM sequence: AAG
attctgtgtattttctcact

SEQ ID NO: 8238 - DNA, 20 bp, Artificial Sequence
  Description of Artificial Sequence: Synthetic oligonucleotide
  Target: ANGPTL3; (-) strand; PAM type: NRG; PAM sequence: CAG
gagcttttagtactattttt

SEQ ID NO: 8239 - DNA, 20 bp, Artificial Sequence
  Description of Artificial Sequence: Synthetic oligonucleotide
  Target: ANGPTL3; (-) strand; PAM type: NRG; PAM sequence: TAG
tttgatgcttttggagcttt

SEQ ID NO: 8240 - DNA, 20 bp, Artificial Sequence
  Description of Artificial Sequence: Synthetic oligonucleotide
  Target: ANGPTL3; (-) strand; PAM type: NRG; PAM sequence: GAG
gactatctttgatgcttttg

SEQ ID NO: 8241 - DNA, 20 bp, Artificial Sequence
  Description of Artificial Sequence: Synthetic oligonucleotide
  Target: ANGPTL3; (-) strand; PAM type: NRG; PAM sequence: TGG
ctgactatctttgatgcttt

SEQ ID NO: 8242 - DNA, 20 bp, Artificial Sequence
  Description of Artificial Sequence: Synthetic oligonucleotide
  Target: ANGPTL3; (-) strand; PAM type: NRG; PAM sequence: AGG
ttcagtaattcactaaaatc

SEQ ID NO: 8243 - DNA, 20 bp, Artificial Sequence
  Description of Artificial Sequence: Synthetic oligonucleotide
  Target: ANGPTL3; (-) strand; PAM type: NRG; PAM sequence: CAG
tttcagtaattcactaaaat

SEQ ID NO: 8244 - DNA, 20 bp, Artificial Sequence
  Description of Artificial Sequence: Synthetic oligonucleotide
  Target: ANGPTL3; (-) strand; PAM type: NRG; PAM sequence: CAG
ctcttgatatagaaattttt

SEQ ID NO: 8245 - DNA, 20 bp, Artificial Sequence
  Description of Artificial Sequence: Synthetic oligonucleotide
  Target: ANGPTL3; (-) strand; PAM type: NRG; PAM sequence: TAG
ttcaaaataaactcttgata

SEQ ID NO: 8246 - DNA, 20 bp, Artificial Sequence
  Description of Artificial Sequence: Synthetic oligonucleotide
  Target: ANGPTL3; (-) strand; PAM type: NRG; PAM sequence: TGG
ggtttcagtaaaattcatac

SEQ ID NO: 8247 - DNA, 20 bp, Artificial Sequence
  Description of Artificial Sequence: Synthetic oligonucleotide
  Target: ANGPTL3; (-) strand; PAM type: NRG; PAM sequence: CAG
gacatgtgtgtacttggttt

SEQ ID NO: 8248 - DNA, 20 bp, Artificial Sequence
  Description of Artificial Sequence: Synthetic oligonucleotide
  Target: ANGPTL3; (-) strand; PAM type: NRG; PAM sequence: TGG
taatgagacatgtgtgtact

SEQ ID NO: 8249 - DNA, 20 bp, Artificial Sequence
  Description of Artificial Sequence: Synthetic oligonucleotide
  Target: ANGPTL3; (-) strand; PAM type: NRG; PAM sequence: GAG
acactagattacctcataat

SEQ ID NO: 8250 - DNA, 20 bp, Artificial Sequence
  Description of Artificial Sequence: Synthetic oligonucleotide
  Target: ANGPTL3; (-) strand; PAM type: NRG; PAM sequence: TAG
ggaaatagattatactacac

SEQ ID NO: 8251 - DNA, 20 bp, Artificial Sequence
  Description of Artificial Sequence: Synthetic oligonucleotide
  Target: ANGPTL3; (-) strand; PAM type: NRG; PAM sequence: TAG
gatgacagagtgtatggaaa

SEQ ID NO: 8252 - DNA, 20 bp, Artificial Sequence
  Description of Artificial Sequence: Synthetic oligonucleotide
  Target: ANGPTL3; (-) strand; PAM type: NRG; PAM sequence: TGG
ttccaggatgacagagtgta

SEQ ID NO: 8253 - DNA, 20 bp, Artificial Sequence
  Description of Artificial Sequence: Synthetic oligonucleotide
  Target: ANGPTL3; (-) strand; PAM type: NRG; PAM sequence: GAG
atgctgattccaggatgaca

SEQ ID NO: 8254 - DNA, 20 bp, Artificial Sequence
  Description of Artificial Sequence: Synthetic oligonucleotide
  Target: ANGPTL3; (-) strand; PAM type: NRG; PAM sequence: CAG
atatgctgattccaggatga

SEQ ID NO: 8255 - DNA, 20 bp, Artificial Sequence
  Description of Artificial Sequence: Synthetic oligonucleotide
  Target: ANGPTL3; (-) strand; PAM type: NRG; PAM sequence: AGG
catgaaaatatgctgattcc

SEQ ID NO: 8256 - DNA, 20 bp, Artificial Sequence
  Description of Artificial Sequence: Synthetic oligonucleotide
  Target: ANGPTL3; (-) strand; PAM type: NRG; PAM sequence: CAG
gcatgaaaatatgctgattc

SEQ ID NO: 8257 - DNA, 20 bp, Artificial Sequence
  Description of Artificial Sequence: Synthetic oligonucleotide
  Target: ANGPTL3; (-) strand; PAM type: NRG; PAM sequence: AAG
ctattaggaagtaaagatac

SEQ ID NO: 8258 - DNA, 20 bp, Artificial Sequence
  Description of Artificial Sequence: Synthetic oligonucleotide
  Target: ANGPTL3; (-) strand; PAM type: NRG; PAM sequence: AAG
agttatgctattaggaagta

SEQ ID NO: 8259 - DNA, 20 bp, Artificial Sequence
  Description of Artificial Sequence: Synthetic oligonucleotide
  Target: ANGPTL3; (-) strand; PAM type: NRG; PAM sequence: AAG
ccatgagttatgctattagg

SEQ ID NO: 8260 - DNA, 20 bp, Artificial Sequence
  Description of Artificial Sequence: Synthetic oligonucleotide
  Target: ANGPTL3; (-) strand; PAM type: NRG; PAM sequence: AGG
cttccatgagttatgctatt

SEQ ID NO: 8261 - DNA, 20 bp, Artificial Sequence
  Description of Artificial Sequence: Synthetic oligonucleotide
  Target: ANGPTL3; (-) strand; PAM type: NRG; PAM sequence: TAG
acttccatgagttatgctat

SEQ ID NO: 8262 - DNA, 20 bp, Artificial Sequence
  Description of Artificial Sequence: Synthetic oligonucleotide
  Target: ANGPTL3; (-) strand; PAM type: NRG; PAM sequence: GAG
atgagttagttgacttccat

SEQ ID NO: 8263 - DNA, 20 bp, Artificial Sequence
  Description of Artificial Sequence: Synthetic oligonucleotide
  Target: ANGPTL3; (-) strand; PAM type: NRG; PAM sequence: TAG
tctaaaattaatgaatgagt

SEQ ID NO: 8264 - DNA, 20 bp, Artificial Sequence
  Description of Artificial Sequence: Synthetic oligonucleotide
  Target: ANGPTL3; (-) strand; PAM type: NRG; PAM sequence: GAG
catttctaaaattaatgaat

SEQ ID NO: 8265 - DNA, 20 bp, Artificial Sequence
  Description of Artificial Sequence: Synthetic oligonucleotide
  Target: ANGPTL3; (-) strand; PAM type: NRG; PAM sequence: AAG
acaaatagtagatgctcaat

SEQ ID NO: 8266 - DNA, 20 bp, Artificial Sequence
  Description of Artificial Sequence: Synthetic oligonucleotide
  Target: ANGPTL3; (-) strand; PAM type: NRG; PAM sequence: TAG
tttttaaaggagacaaatag

SEQ ID NO: 8267 - DNA, 20 bp, Artificial Sequence
  Description of Artificial Sequence: Synthetic oligonucleotide
  Target: ANGPTL3; (-) strand; PAM type: NRG; PAM sequence: TAG
tgttttttaaaggagacaaa

SEQ ID NO: 8268 - DNA, 20 bp, Artificial Sequence
  Description of Artificial Sequence: Synthetic oligonucleotide
  Target: ANGPTL3; (-) strand; PAM type: NRG; PAM sequence: GAG
ttggaatatgttttttaaag

SEQ ID NO: 8269 - DNA, 20 bp, Artificial Sequence
  Description of Artificial Sequence: Synthetic oligonucleotide
  Target: ANGPTL3; (-) strand; PAM type: NRG; PAM sequence: AGG
atttggaatatgttttttaa

SEQ ID NO: 8270 - DNA, 20 bp, Artificial Sequence
  Description of Artificial Sequence: Synthetic oligonucleotide
  Target: ANGPTL3; (-) strand; PAM type: NRG; PAM sequence: AAG
aatttggaatatgtttttta

SEQ ID NO: 8271 - DNA, 20 bp, Artificial Sequence
  Description of Artificial Sequence: Synthetic oligonucleotide
  Target: ANGPTL3; (-) strand; PAM type: NRG; PAM sequence: TGG
agtatatatgagtacaaatt

SEQ ID NO: 8272 - DNA, 20 bp, Artificial Sequence
  Description of Artificial Sequence: Synthetic oligonucleotide
  Target: ANGPTL3; (-) strand; PAM type: NRG; PAM sequence: GAG
gcagaaggtagagtatatat

SEQ ID NO: 8273 - DNA, 20 bp, Artificial Sequence
  Description of Artificial Sequence: Synthetic oligonucleotide
  Target: ANGPTL3; (-) strand; PAM type: NRG; PAM sequence: GAG
ttatcctacagcagaaggta

SEQ ID NO: 8274 - DNA, 20 bp, Artificial Sequence
  Description of Artificial Sequence: Synthetic oligonucleotide
  Target: ANGPTL3; (-) strand; PAM type: NRG; PAM sequence: TAG
gattatcctacagcagaagg

SEQ ID NO: 8275 - DNA, 20 bp, Artificial Sequence
  Description of Artificial Sequence: Synthetic oligonucleotide
  Target: ANGPTL3; (-) strand; PAM type: NRG; PAM sequence: AGG
tttgattatcctacagcaga

SEQ ID NO: 8276 - DNA, 20 bp, Artificial Sequence
  Description of Artificial Sequence: Synthetic oligonucleotide
  Target: ANGPTL3; (-) strand; PAM type: NRG; PAM sequence: AAG
atttgattatcctacagcag

SEQ ID NO: 8277 - DNA, 20 bp, Artificial Sequence
  Description of Artificial Sequence: Synthetic oligonucleotide
  Target: ANGPTL3; (-) strand; PAM type: NRG; PAM sequence: CAG
gaaatttgattatcctacag

SEQ ID NO: 8278 - DNA, 20 bp, Artificial Sequence
  Description of Artificial Sequence: Synthetic oligonucleotide
  Target: ANGPTL3; (-) strand; PAM type: NRG; PAM sequence: CAG
aaggaaatttgattatccta

SEQ ID NO: 8279 - DNA, 20 bp, Artificial Sequence
  Description of Artificial Sequence: Synthetic oligonucleotide
  Target: ANGPTL3; (-) strand; PAM type: NRG; PAM sequence: AGG
tgatggggaaaaaaatcaca

SEQ ID NO: 8280 - DNA, 20 bp, Artificial Sequence
  Description of Artificial Sequence: Synthetic oligonucleotide
  Target: ANGPTL3; (-) strand; PAM type: NRG; PAM sequence: AAG
gtgatggggaaaaaaatcac

SEQ ID NO: 8281 - DNA, 20 bp, Artificial Sequence
  Description of Artificial Sequence: Synthetic oligonucleotide
  Target: ANGPTL3; (-) strand; PAM type: NRG; PAM sequence: GGG
gtttatggctgttagtgatg

SEQ ID NO: 8282 - DNA, 20 bp, Artificial Sequence
  Description of Artificial Sequence: Synthetic oligonucleotide
  Target: ANGPTL3; (-) strand; PAM type: NRG; PAM sequence: GGG
agtttatggctgttagtgat

SEQ ID NO: 8283 - DNA, 20 bp, Artificial Sequence
  Description of Artificial Sequence: Synthetic oligonucleotide
  Target: ANGPTL3; (-) strand; PAM type: NRG; PAM sequence: TGG
gagtttatggctgttagtga

SEQ ID NO: 8284 - DNA, 20 bp, Artificial Sequence
  Description of Artificial Sequence: Synthetic oligonucleotide
  Target: ANGPTL3; (-) strand; PAM type: NRG; PAM sequence: TAG
agtgcagagtttatggctgt

SEQ ID NO: 8285 - DNA, 20 bp, Artificial Sequence
  Description of Artificial Sequence: Synthetic oligonucleotide
  Target: ANGPTL3; (-) strand; PAM type: NRG; PAM sequence: TGG
atacataagtgcagagttta

SEQ ID NO: 8286 - DNA, 20 bp, Artificial Sequence
  Description of Artificial Sequence: Synthetic oligonucleotide
  Target: ANGPTL3; (-) strand; PAM type: NRG; PAM sequence: GAG
gtagtacatacataagtgca

SEQ ID NO: 8287 - DNA, 20 bp, Artificial Sequence
  Description of Artificial Sequence: Synthetic oligonucleotide
  Target: ANGPTL3; (-) strand; PAM type: NRG; PAM sequence: CAG
cagtagtacatacataagtg

SEQ ID NO: 8288 - DNA, 20 bp, Artificial Sequence
  Description of Artificial Sequence: Synthetic oligonucleotide
  Target: ANGPTL3; (-) strand; PAM type: NRG; PAM sequence: AAG
tcactcagtagtacatacat

SEQ ID NO: 8289 - DNA, 20 bp, Artificial Sequence
  Description of Artificial Sequence: Synthetic oligonucleotide
  Target: ANGPTL3; (-) strand; PAM type: NRG; PAM sequence: TAG
tgtgtttgataatcactcag

SEQ ID NO: 8290 - DNA, 20 bp, Artificial Sequence
  Description of Artificial Sequence: Synthetic oligonucleotide
  Target: ANGPTL3; (-) strand; PAM type: NRG; PAM sequence: CAG
tgctgtgtttgataatcact

SEQ ID NO: 8291 - DNA, 20 bp, Artificial Sequence
  Description of Artificial Sequence: Synthetic oligonucleotide
  Target: ANGPTL3; (-) strand; PAM type: NRG; PAM sequence: GGG
tgataaaagggccaattgtt

SEQ ID NO: 8292 - DNA, 20 bp, Artificial Sequence
  Description of Artificial Sequence: Synthetic oligonucleotide
  Target: ANGPTL3; (-) strand; PAM type: NRG; PAM sequence: TGG
ttgataaaagggccaattgt

SEQ ID NO: 8293 - DNA, 20 bp, Artificial Sequence
  Description of Artificial Sequence: Synthetic oligonucleotide
  Target: ANGPTL3; (-) strand; PAM type: NRG; PAM sequence: GGG
tactttggactttgataaaa

SEQ ID NO: 8294 - DNA, 20 bp, Artificial Sequence
  Description of Artificial Sequence: Synthetic oligonucleotide
  Target: ANGPTL3; (-) strand; PAM type: NRG; PAM sequence: AGG
atactttggactttgataaa

SEQ ID NO: 8295 - DNA, 20 bp, Artificial Sequence
  Description of Artificial Sequence: Synthetic oligonucleotide
  Target: ANGPTL3; (-) strand; PAM type: NRG; PAM sequence: AAG
aatactttggactttgataa

SEQ ID NO: 8296 - DNA, 20 bp, Artificial Sequence
  Description of Artificial Sequence: Synthetic oligonucleotide
  Target: ANGPTL3; (-) strand; PAM type: NRG; PAM sequence: TGG
gatttgccatgataatactt

SEQ ID NO: 8297 - DNA, 20 bp, Artificial Sequence
  Description of Artificial Sequence: Synthetic oligonucleotide
  Target: ANGPTL3; (-) strand; PAM type: NRG; PAM sequence: TAG
ccagttaagtaattttaccc

SEQ ID NO: 8298 - DNA, 20 bp, Artificial Sequence
  Description of Artificial Sequence: Synthetic oligonucleotide
  Target: ANGPTL3; (-) strand; PAM type: NRG; PAM sequence: AAG
ccttgaactgtgcaccagtt

SEQ ID NO: 8299 - DNA, 20 bp, Artificial Sequence
  Description of Artificial Sequence: Synthetic oligonucleotide
  Target: ANGPTL3; (-) strand; PAM type: NRG; PAM sequence: CAG
catgaccttgaactgtgcac

SEQ ID NO: 8300 - DNA, 20 bp, Artificial Sequence
  Description of Artificial Sequence: Synthetic oligonucleotide
  Target: ANGPTL3; (-) strand; PAM type: NRG; PAM sequence: TAG
gggttataatagaggattgt

SEQ ID NO: 8301 - DNA, 20 bp, Artificial Sequence
  Description of Artificial Sequence: Synthetic oligonucleotide
  Target: ANGPTL3; (-) strand; PAM type: NRG; PAM sequence: AGG
tttattaagggttataatag

SEQ ID NO: 8302 - DNA, 20 bp, Artificial Sequence
  Description of Artificial Sequence: Synthetic oligonucleotide
  Target: ANGPTL3; (-) strand; PAM type: NRG; PAM sequence: GAG
ttttattaagggttataata

SEQ ID NO: 8303 - DNA, 20 bp, Artificial Sequence
  Description of Artificial Sequence: Synthetic oligonucleotide
  Target: ANGPTL3; (-) strand; PAM type: NRG; PAM sequence: TAG
cattttattaagggttataa

SEQ ID NO: 8304 - DNA, 20 bp, Artificial Sequence
  Description of Artificial Sequence: Synthetic oligonucleotide
  Target: ANGPTL3; (-) strand; PAM type: NRG; PAM sequence: GGG
ttaaaacctcattttattaa

SEQ ID NO: 8305 - DNA, 20 bp, Artificial Sequence
  Description of Artificial Sequence: Synthetic oligonucleotide
  Target: ANGPTL3; (-) strand; PAM type: NRG; PAM sequence: AGG
attaaaacctcattttatta

SEQ ID NO: 8306 - DNA, 20 bp, Artificial Sequence
  Description of Artificial Sequence: Synthetic oligonucleotide
  Target: ANGPTL3; (-) strand; PAM type: NRG; PAM sequence: AAG
cattaaaacctcattttatt

SEQ ID NO: 8307 - DNA, 20 bp, Artificial Sequence
  Description of Artificial Sequence: Synthetic oligonucleotide
  Target: ANGPTL3; (-) strand; PAM type: NRG; PAM sequence: AAG
gtattttagatagaattctt

SEQ ID NO: 8308 - DNA, 20 bp, Artificial Sequence
  Description of Artificial Sequence: Synthetic oligonucleotide
  Target: ANGPTL3; (-) strand; PAM type: NRG; PAM sequence: TAG
aacagcctttgtattttaga

SEQ ID NO: 8309 - DNA, 20 bp, Artificial Sequence
  Description of Artificial Sequence: Synthetic oligonucleotide
  Target: ANGPTL3; (-) strand; PAM type: NRG; PAM sequence: TAG
gaaaaacagcctttgtattt

SEQ ID NO: 8310 - DNA, 20 bp, Artificial Sequence
  Description of Artificial Sequence: Synthetic oligonucleotide
  Target: ANGPTL3; (-) strand; PAM type: NRG; PAM sequence: CAG
aaacatgaatttaggaaaaa

SEQ ID NO: 8311 - DNA, 20 bp, Artificial Sequence
  Description of Artificial Sequence: Synthetic oligonucleotide
  Target: ANGPTL3; (-) strand; PAM type: NRG; PAM sequence: AGG
ttaggactaaacatgaattt

SEQ ID NO: 8312 - DNA, 20 bp, Artificial Sequence
  Description of Artificial Sequence: Synthetic oligonucleotide
  Target: ANGPTL3; (-) strand; PAM type: NRG; PAM sequence: TAG
cttaggactaaacatgaatt

SEQ ID NO: 8313 - DNA, 20 bp, Artificial Sequence
  Description of Artificial Sequence: Synthetic oligonucleotide
  Target: ANGPTL3; (-) strand; PAM type: NRG; PAM sequence: AGG
ttagatgtatgactgttctt

SEQ ID NO: 8314 - DNA, 20 bp, Artificial Sequence
  Description of Artificial Sequence: Synthetic oligonucleotide
  Target: ANGPTL3; (-) strand; PAM type: NRG; PAM sequence: TAG
attagatgtatgactgttct

SEQ ID NO: 8315 - DNA, 20 bp, Artificial Sequence
  Description of Artificial Sequence: Synthetic oligonucleotide
  Target: ANGPTL3; (-) strand; PAM type: NRG; PAM sequence: TAG
tatatacccagtcattttat

SEQ ID NO: 8316 - DNA, 20 bp, Artificial Sequence
  Description of Artificial Sequence: Synthetic oligonucleotide
  Target: ANGPTL3; (-) strand; PAM type: NRG; PAM sequence: CAG
gctctttcaaattatatacc

SEQ ID NO: 8317 - DNA, 20 bp, Artificial Sequence
  Description of Artificial Sequence: Synthetic oligonucleotide
  Target: ANGPTL3; (-) strand; PAM type: NRG; PAM sequence: TAG
acaaccttacatcttcaagg

SEQ ID NO: 8318 - DNA, 20 bp, Artificial Sequence
  Description of Artificial Sequence: Synthetic oligonucleotide
  Target: ANGPTL3; (-) strand; PAM type: NRG; PAM sequence: AGG
gctacaaccttacatcttca

SEQ ID NO: 8319 - DNA, 20 bp, Artificial Sequence
  Description of Artificial Sequence: Synthetic oligonucleotide
  Target: ANGPTL3; (-) strand; PAM type: NRG; PAM sequence: AAG
agctacaaccttacatcttc

SEQ ID NO: 8320 - DNA, 20 bp, Artificial Sequence
  Description of Artificial Sequence: Synthetic oligonucleotide
  Target: ANGPTL3; (-) strand; PAM type: NRG; PAM sequence: TAG
actgtgtattttaagataaa

SEQ ID NO: 8321 - DNA, 20 bp, Artificial Sequence
  Description of Artificial Sequence: Synthetic oligonucleotide
  Target: ANGPTL3; (-) strand; PAM type: NRG; PAM sequence: AAG
gaggtttgactgtgtatttt

SEQ ID NO: 8322 - DNA, 20 bp, Artificial Sequence
  Description of Artificial Sequence: Synthetic oligonucleotide
  Target: ANGPTL3; (-) strand; PAM type: NRG; PAM sequence: AGG
tctattgggtgtggaaactg

SEQ ID NO: 8323 - DNA, 20 bp, Artificial Sequence
  Description of Artificial Sequence: Synthetic oligonucleotide
  Target: ANGPTL3; (-) strand; PAM type: NRG; PAM sequence: GAG
atctattgggtgtggaaact

SEQ ID NO: 8324 - DNA, 20 bp, Artificial Sequence
  Description of Artificial Sequence: Synthetic oligonucleotide
  Target: ANGPTL3; (-) strand; PAM type: NRG; PAM sequence: TGG
ttattcccatctattgggtg

SEQ ID NO: 8325 - DNA, 20 bp, Artificial Sequence
  Description of Artificial Sequence: Synthetic oligonucleotide
  Target: ANGPTL3; (-) strand; PAM type: NRG; PAM sequence: GGG
gattattattcccatctatt

SEQ ID NO: 8326 - DNA, 20 bp, Artificial Sequence
  Description of Artificial Sequence: Synthetic oligonucleotide
  Target: ANGPTL3; (-) strand; PAM type: NRG; PAM sequence: TGG
ggattattattcccatctat

SEQ ID NO: 8327 - DNA, 20 bp, Artificial Sequence
  Description of Artificial Sequence: Synthetic oligonucleotide
  Target: ANGPTL3; (-) strand; PAM type: NRG; PAM sequence: AGG
gaagtattaatagatttgac

SEQ ID NO: 8328 - DNA, 20 bp, Artificial Sequence
  Description of Artificial Sequence: Synthetic oligonucleotide
  Target: ANGPTL3; (-) strand; PAM type: NRG; PAM sequence: CAG
tgaagtattaatagatttga

SEQ ID NO: 8329 - DNA, 20 bp, Artificial Sequence
  Description of Artificial Sequence: Synthetic oligonucleotide
  Target: ANGPTL3; (-) strand; PAM type: NRG; PAM sequence: TAG
acaatcccatgaagtattaa

SEQ ID NO: 8330 - DNA, 20 bp, Artificial Sequence
  Description of Artificial Sequence: Synthetic oligonucleotide
  Target: ANGPTL3; (-) strand; PAM type: NRG; PAM sequence: AAG
ttgatgattacaatcccatg

SEQ ID NO: 8331 - DNA, 20 bp, Artificial Sequence
  Description of Artificial Sequence: Synthetic oligonucleotide
  Target: ANGPTL3; (-) strand; PAM type: NRG; PAM sequence: TGG
agctattcaaatacattatc

SEQ ID NO: 8332 - DNA, 20 bp, Artificial Sequence
  Description of Artificial Sequence: Synthetic oligonucleotide
  Target: ANGPTL3; (-) strand; PAM type: NRG; PAM sequence: AAG
ttagaactttatagttcata

SEQ ID NO: 8333 - DNA, 20 bp, Artificial Sequence
  Description of Artificial Sequence: Synthetic oligonucleotide
  Target: ANGPTL3; (-) strand; PAM type: NRG; PAM sequence: TAG
tacatttgtttagaacttta

SEQ ID NO: 8334 - DNA, 20 bp, Artificial Sequence
  Description of Artificial Sequence: Synthetic oligonucleotide
  Target: ANGPTL3; (-) strand; PAM type: NRG; PAM sequence: TAG
aaaaagtatatacatttgtt

SEQ ID NO: 8335 - DNA, 20 bp, Artificial Sequence
  Description of Artificial Sequence: Synthetic oligonucleotide
  Target: ANGPTL3; (-) strand; PAM type: NRG; PAM sequence: AAG
cggaagaacctgtttttaaa

SEQ ID NO: 8336 - DNA, 20 bp, Artificial Sequence
  Description of Artificial Sequence: Synthetic oligonucleotide
  Target: ANGPTL3; (-) strand; PAM type: NRG; PAM sequence: AAG
gaatgtgaaaaatgacacgg

SEQ ID NO: 8337 - DNA, 20 bp, Artificial Sequence
  Description of Artificial Sequence: Synthetic oligonucleotide
  Target: ANGPTL3; (-) strand; PAM type: NRG; PAM sequence: CGG
aaggaatgtgaaaaatgaca

SEQ ID NO: 8338 - DNA, 20 bp, Artificial Sequence
  Description of Artificial Sequence: Synthetic oligonucleotide
  Target: ANGPTL3; (-) strand; PAM type: NRG; PAM sequence: AGG
tgtagagattatttacttaa

SEQ ID NO: 8339 - DNA, 20 bp, Artificial Sequence
  Description of Artificial Sequence: Synthetic oligonucleotide
  Target: ANGPTL3; (-) strand; PAM type: NRG; PAM sequence: AAG
ttgtagagattatttactta

SEQ ID NO: 8340 - DNA, 20 bp, Artificial Sequence
  Description of Artificial Sequence: Synthetic oligonucleotide
  Target: ANGPTL3; (-) strand; PAM type: NRG; PAM sequence: GAG
tcagttaggaagcgtttgta

SEQ ID NO: 8341 - DNA, 20 bp, Artificial Sequence
  Description of Artificial Sequence: Synthetic oligonucleotide
  Target: ANGPTL3; (-) strand; PAM type: NRG; PAM sequence: TAG
gttcagttaggaagcgtttg

SEQ ID NO: 8342 - DNA, 20 bp, Artificial Sequence
  Description of Artificial Sequence: Synthetic oligonucleotide
  Target: ANGPTL3; (-) strand; PAM type: NRG; PAM sequence: AAG
ttataatatgttcagttagg

SEQ ID NO: 8343 - DNA, 20 bp, Artificial Sequence
  Description of Artificial Sequence: Synthetic oligonucleotide
  Target: ANGPTL3; (-) strand; PAM type: NRG; PAM sequence: AGG
gaattataatatgttcagtt

SEQ ID NO: 8344 - DNA, 20 bp, Artificial Sequence
  Description of Artificial Sequence: Synthetic oligonucleotide
  Target: ANGPTL3; (-) strand; PAM type: NRG; PAM sequence: TAG
agaattataatatgttcagt

SEQ ID NO: 8345 - DNA, 20 bp, Artificial Sequence
  Description of Artificial Sequence: Synthetic oligonucleotide
  Target: ANGPTL3; (-) strand; PAM type: NRG; PAM sequence: CAG
cctgagaattataatatgtt

SEQ ID NO: 8346 - DNA, 20 bp, Artificial Sequence
  Description of Artificial Sequence: Synthetic oligonucleotide
  Target: ANGPTL3; (-) strand; PAM type: NRG; PAM sequence: GAG
cagttttgttcttctgtcct

SEQ ID NO: 8347 - DNA, 20 bp, Artificial Sequence
  Description of Artificial Sequence: Synthetic oligonucleotide
  Target: ANGPTL3; (-) strand; PAM type: NRG; PAM sequence: CAG
gatgcaaactctgagaaggg

SEQ ID NO: 8348 - DNA, 20 bp, Artificial Sequence
  Description of Artificial Sequence: Synthetic oligonucleotide
  Target: ANGPTL3; (-) strand; PAM type: NRG; PAM sequence: GGG
acagatgcaaactctgagaa

SEQ ID NO: 8349 - DNA, 20 bp, Artificial Sequence
  Description of Artificial Sequence: Synthetic oligonucleotide
  Target: ANGPTL3; (-) strand; PAM type: NRG; PAM sequence: AGG
aacagatgcaaactctgaga

SEQ ID NO: 8350 - DNA, 20 bp, Artificial Sequence
  Description of Artificial Sequence: Synthetic oligonucleotide
  Target: ANGPTL3; (-) strand; PAM type: NRG; PAM sequence: AAG
aaacagatgcaaactctgag

SEQ ID NO: 8351 - DNA, 20 bp, Artificial Sequence
  Description of Artificial Sequence: Synthetic oligonucleotide
  Target: ANGPTL3; (-) strand; PAM type: NRG; PAM sequence: GAG
cagaaacagatgcaaactct

SEQ ID NO: 8352 - DNA, 20 bp, Artificial Sequence
  Description of Artificial Sequence: Synthetic oligonucleotide
  Target: ANGPTL3; (-) strand; PAM type: NRG; PAM sequence: CAG
aaggagtaaagttccagaaa

SEQ ID NO: 8353 - DNA, 20 bp, Artificial Sequence
  Description of Artificial Sequence: Synthetic oligonucleotide
  Target: ANGPTL3; (-) strand; PAM type: NRG; PAM sequence: CAG
gaagggaaggagtaaagttc

SEQ ID NO: 8354 - DNA, 20 bp, Artificial Sequence
  Description of Artificial Sequence: Synthetic oligonucleotide
  Target: ANGPTL3; (-) strand; PAM type: NRG; PAM sequence: AAG
gattgtgaagggaaggagta

SEQ ID NO: 8355 - DNA, 20 bp, Artificial Sequence
  Description of Artificial Sequence: Synthetic oligonucleotide
  Target: ANGPTL3; (-) strand; PAM type: NRG; PAM sequence: GAG
tcttagattgtgaagggaag

SEQ ID NO: 8356 - DNA, 20 bp, Artificial Sequence
  Description of Artificial Sequence: Synthetic oligonucleotide
  Target: ANGPTL3; (-) strand; PAM type: NRG; PAM sequence: AGG
tatcttagattgtgaaggga

SEQ ID NO: 8357 - DNA, 20 bp, Artificial Sequence
  Description of Artificial Sequence: Synthetic oligonucleotide
  Target: ANGPTL3; (-) strand; PAM type: NRG; PAM sequence: AAG
ttatcttagattgtgaaggg

SEQ ID NO: 8358 - DNA, 20 bp, Artificial Sequence
  Description of Artificial Sequence: Synthetic oligonucleotide
  Target: ANGPTL3; (-) strand; PAM type: NRG; PAM sequence: GGG
gtgttatcttagattgtgaa

SEQ ID NO: 8359 - DNA, 20 bp, Artificial Sequence
  Description of Artificial Sequence: Synthetic oligonucleotide
  Target: ANGPTL3; (-) strand; PAM type: NRG; PAM sequence: AGG
agtgttatcttagattgtga

SEQ ID NO: 8360 - DNA, 20 bp, Artificial Sequence
  Description of Artificial Sequence: Synthetic oligonucleotide
  Target: ANGPTL3; (-) strand; PAM type: NRG; PAM sequence: AAG
gagtgttatcttagattgtg

SEQ ID NO: 8361 - DNA, 20 bp, Artificial Sequence
  Description of Artificial Sequence: Synthetic oligonucleotide
  Target: ANGPTL3; (-) strand; PAM type: NRG; PAM sequence: TAG
aaggtgatggagtgttatct

SEQ ID NO: 8362 - DNA, 20 bp, Artificial Sequence
  Description of Artificial Sequence: Synthetic oligonucleotide
  Target: ANGPTL3; (-) strand; PAM type: NRG; PAM sequence: GAG
gcttgcatctgaaggtgatg

SEQ ID NO: 8363 - DNA, 20 bp, Artificial Sequence
  Description of Artificial Sequence: Synthetic oligonucleotide
  Target: ANGPTL3; (-) strand; PAM type: NRG; PAM sequence: TGG
gggcttgcatctgaaggtga

SEQ ID NO: 8364 - DNA, 20 bp, Artificial Sequence
  Description of Artificial Sequence: Synthetic oligonucleotide
  Target: ANGPTL3; (-) strand; PAM type: NRG; PAM sequence: AGG
agttaggggcttgcatctga

SEQ ID NO: 8365 - DNA, 20 bp, Artificial Sequence
  Description of Artificial Sequence: Synthetic oligonucleotide
  Target: ANGPTL3; (-) strand; PAM type: NRG; PAM sequence: AAG
tagttaggggcttgcatctg

SEQ ID NO: 8366 - DNA, 20 bp, Artificial Sequence
  Description of Artificial Sequence: Synthetic oligonucleotide
  Target: ANGPTL3; (-) strand; PAM type: NRG; PAM sequence: GGG
acccagaagtttttagttag

SEQ ID NO: 8367 - DNA, 20 bp, Artificial Sequence
  Description of Artificial Sequence: Synthetic oligonucleotide
  Target: ANGPTL3; (-) strand; PAM type: NRG; PAM sequence: GGG
cacccagaagtttttagtta

SEQ ID NO: 8368 - DNA, 20 bp, Artificial Sequence
  Description of Artificial Sequence: Synthetic oligonucleotide
  Target: ANGPTL3; (-) strand; PAM type: NRG; PAM sequence: AGG
ccacccagaagtttttagtt

SEQ ID NO: 8369 - DNA, 20 bp, Artificial Sequence
  Description of Artificial Sequence: Synthetic oligonucleotide
  Target: ANGPTL3; (-) strand; PAM type: NRG; PAM sequence: TAG
gccacccagaagtttttagt

SEQ ID NO: 8370 - DNA, 20 bp, Artificial Sequence
  Description of Artificial Sequence: Synthetic oligonucleotide
  Target: ANGPTL3; (-) strand; PAM type: NRG; PAM sequence: TAG
catagccacccagaagtttt

SEQ ID NO: 8371 - DNA, 20 bp, Artificial Sequence
  Description of Artificial Sequence: Synthetic oligonucleotide
  Target: ANGPTL3; (-) strand; PAM type: NRG; PAM sequence: AAG
attttaacatagccacccag

SEQ ID NO: 8372 - DNA, 20 bp, Artificial Sequence
  Description of Artificial Sequence: Synthetic oligonucleotide
  Target: ANGPTL3; (-) strand; PAM type: NRG; PAM sequence: CAG
aacattttaacatagccacc

SEQ ID NO: 8373 - DNA, 20 bp, Artificial Sequence
  Description of Artificial Sequence: Synthetic oligonucleotide
  Target: ANGPTL3; (-) strand; PAM type: NRG; PAM sequence: TAG
tatttcctaacattttaaca

SEQ ID NO: 8374 - DNA, 20 bp, Artificial Sequence
  Description of Artificial Sequence: Synthetic oligonucleotide
  Target: ANGPTL3; (-) strand; PAM type: NRG; PAM sequence: GAG
aaaaaagaattctgagtcaa

SEQ ID NO: 8375 - DNA, 20 bp, Artificial Sequence
  Description of Artificial Sequence: Synthetic oligonucleotide
  Target: ANGPTL3; (-) strand; PAM type: NRG; PAM sequence: AAG
aaaaaaaagaattctgagtc

SEQ ID NO: 8376 - DNA, 20 bp, Artificial Sequence
  Description of Artificial Sequence: Synthetic oligonucleotide
  Target: ANGPTL3; (-) strand; PAM type: NRG; PAM sequence: GAG
tcgaaaaaaaaaagaattct

SEQ ID NO: 8377 - DNA, 20 bp, Artificial Sequence
  Description of Artificial Sequence: Synthetic oligonucleotide
  Target: ANGPTL3; (-) strand; PAM type: NRG; PAM sequence: AAG
gactccatctcgaaaaaaaa

SEQ ID NO: 8378 - DNA, 20 bp, Artificial Sequence
  Description of Artificial Sequence: Synthetic oligonucleotide
  Target: ANGPTL3; (-) strand; PAM type: NRG; PAM sequence: GAG
tccagcctgggtgacagagc

SEQ ID NO: 8379 - DNA, 20 bp, Artificial Sequence
  Description of Artificial Sequence: Synthetic oligonucleotide
  Target: ANGPTL3; (-) strand; PAM type: NRG; PAM sequence: GAG
gcactccagcctgggtgaca

SEQ ID NO: 8380 - DNA, 20 bp, Artificial Sequence
  Description of Artificial Sequence: Synthetic oligonucleotide
  Target: ANGPTL3; (-) strand; PAM type: NRG; PAM sequence: CAG
ctgcactccagcctgggtga

SEQ ID NO: 8381 - DNA, 20 bp, Artificial Sequence
  Description of Artificial Sequence: Synthetic oligonucleotide
  Target: ANGPTL3; (-) strand; PAM type: NRG; PAM sequence: GGG
gtgccactgcactccagcct

SEQ ID NO: 8382 - DNA, 20 bp, Artificial Sequence
  Description of Artificial Sequence: Synthetic oligonucleotide
  Target: ANGPTL3; (-) strand; PAM type: NRG; PAM sequence: TGG
agtgccactgcactccagcc

SEQ ID NO: 8383 - DNA, 20 bp, Artificial Sequence
  Description of Artificial Sequence: Synthetic oligonucleotide
  Target: ANGPTL3; (-) strand; PAM type: NRG; PAM sequence: CAG
tgtgcagtgccactgcactc

SEQ ID NO: 8384 - DNA, 20 bp, Artificial Sequence
  Description of Artificial Sequence: Synthetic oligonucleotide
  Target: ANGPTL3; (-) strand; PAM type: NRG; PAM sequence: CAG
agatcactcagctcactgtg

SEQ ID NO: 8385 - DNA, 20 bp, Artificial Sequence
  Description of Artificial Sequence: Synthetic oligonucleotide
  Target: ANGPTL3; (-) strand; PAM type: NRG; PAM sequence: CAG
tgcagagagctgagatcact

SEQ ID NO: 8386 - DNA, 20 bp, Artificial Sequence
  Description of Artificial Sequence: Synthetic oligonucleotide
  Target: ANGPTL3; (-) strand; PAM type: NRG; PAM sequence: GAG
ggcggaggttgcagagagct

SEQ ID NO: 8387 - DNA, 20 bp, Artificial Sequence
  Description of Artificial Sequence: Synthetic oligonucleotide
  Target: ANGPTL3; (-) strand; PAM type: NRG; PAM sequence: GAG
caggaggcggaggttgcaga

SEQ ID NO: 8388 - DNA, 20 bp, Artificial Sequence
  Description of Artificial Sequence: Synthetic oligonucleotide
  Target: ANGPTL3; (-) strand; PAM type: NRG; PAM sequence: GAG
cccaggaggcggaggttgca

SEQ ID NO: 8389 - DNA, 20 bp, Artificial Sequence
  Description of Artificial Sequence: Synthetic oligonucleotide
  Target: ANGPTL3; (-) strand; PAM type: NRG; PAM sequence: CAG
aacccaggaggcggaggttg

SEQ ID NO: 8390 - DNA, 20 bp, Artificial Sequence
  Description of Artificial Sequence: Synthetic oligonucleotide
  Target: ANGPTL3; (-) strand; PAM type: NRG; PAM sequence: AGG
cacttgaacccaggaggcgg

SEQ ID NO: 8391 - DNA, 20 bp, Artificial Sequence
  Description of Artificial Sequence: Synthetic oligonucleotide
  Target: ANGPTL3; (-) strand; PAM type: NRG; PAM sequence: GAG
tcacttgaacccaggaggcg

SEQ ID NO: 8392 - DNA, 20 bp, Artificial Sequence
  Description of Artificial Sequence: Synthetic oligonucleotide
  Target: ANGPTL3; (-) strand; PAM type: NRG; PAM sequence: CGG
aatcacttgaacccaggagg

SEQ ID NO: 8393 - DNA, 20 bp, Artificial Sequence
  Description of Artificial Sequence: Synthetic oligonucleotide
  Target: ANGPTL3; (-) strand; PAM type: NRG; PAM sequence: AGG
gagaatcacttgaacccagg

SEQ ID NO: 8394 - DNA, 20 bp, Artificial Sequence
  Description of Artificial Sequence: Synthetic oligonucleotide
  Target: ANGPTL3; (-) strand; PAM type: NRG; PAM sequence: GAG
ggagaatcacttgaacccag

SEQ ID NO: 8395 - DNA, 20 bp, Artificial Sequence
  Description of Artificial Sequence: Synthetic oligonucleotide
  Target: ANGPTL3; (-) strand; PAM type: NRG; PAM sequence: AGG
caggagaatcacttgaaccc

SEQ ID NO: 8396 - DNA, 20 bp, Artificial Sequence
  Description of Artificial Sequence: Synthetic oligonucleotide
  Target: ANGPTL3; (-) strand; PAM type: NRG; PAM sequence: CAG
gcaggagaatcacttgaacc

SEQ ID NO: 8397 - DNA, 20 bp, Artificial Sequence
  Description of Artificial Sequence: Synthetic oligonucleotide
  Target: ANGPTL3; (-) strand; PAM type: NRG; PAM sequence: GAG
tactcaggagtctgaggcag

SEQ ID NO: 8398 - DNA, 20 bp, Artificial Sequence
  Description of Artificial Sequence: Synthetic oligonucleotide
  Target: ANGPTL3; (-) strand; PAM type: NRG; PAM sequence: AGG
gctactcaggagtctgaggc

SEQ ID NO: 8399 - DNA, 20 bp, Artificial Sequence
  Description of Artificial Sequence: Synthetic oligonucleotide
  Target: ANGPTL3; (-) strand; PAM type: NRG; PAM sequence: CAG
agctactcaggagtctgagg

SEQ ID NO: 8400 - DNA, 20 bp, Artificial Sequence
  Description of Artificial Sequence: Synthetic oligonucleotide
  Target: ANGPTL3; (-) strand; PAM type: NRG; PAM sequence: AGG
cctagctactcaggagtctg

SEQ ID NO: 8401 - DNA, 20 bp, Artificial Sequence
  Description of Artificial Sequence: Synthetic oligonucleotide
  Target: ANGPTL3; (-) strand; PAM type: NRG; PAM sequence: GAG
tcctagctactcaggagtct

SEQ ID NO: 8402 - DNA, 20 bp, Artificial Sequence
  Description of Artificial Sequence: Synthetic oligonucleotide
  Target: ANGPTL3; (-) strand; PAM type: NRG; PAM sequence: GAG
ctgtaatcctagctactcag

SEQ ID NO: 8403 - DNA, 20 bp, Artificial Sequence
  Description of Artificial Sequence: Synthetic oligonucleotide
  Target: ANGPTL3; (-) strand; PAM type: NRG; PAM sequence: AGG
acctgtaatcctagctactc

SEQ ID NO: 8404 - DNA, 20 bp, Artificial Sequence
  Description of Artificial Sequence: Synthetic oligonucleotide
  Target: ANGPTL3; (-) strand; PAM type: NRG; PAM sequence: CAG
tacctgtaatcctagctact

SEQ ID NO: 8405 - DNA, 20 bp, Artificial Sequence
  Description of Artificial Sequence: Synthetic oligonucleotide
  Target: ANGPTL3; (-) strand; PAM type: NRG; PAM sequence: TAG
gtggcacatacctgtaatcc

SEQ ID NO: 8406 - DNA, 20 bp, Artificial Sequence
  Description of Artificial Sequence: Synthetic oligonucleotide
  Target: ANGPTL3; (-) strand; PAM type: NRG; PAM sequence: TGG
caaaaattagccaggcatgg

SEQ ID NO: 8407 - DNA, 20 bp, Artificial Sequence
  Description of Artificial Sequence: Synthetic oligonucleotide
  Target: ANGPTL3; (-) strand; PAM type: NRG; PAM sequence: TGG
atacaaaaattagccaggca

SEQ ID NO: 8408 - DNA, 20 bp, Artificial Sequence
  Description of Artificial Sequence: Synthetic oligonucleotide
  Target: ANGPTL3; (-) strand; PAM type: NRG; PAM sequence: AGG
taaaaatacaaaaattagcc

SEQ ID NO: 8409 - DNA, 20 bp, Artificial Sequence
  Description of Artificial Sequence: Synthetic oligonucleotide
  Target: ANGPTL3; (-) strand; PAM type: NRG; PAM sequence: CAG
ctaaaaatacaaaaattagc

SEQ ID NO: 8410 - DNA, 20 bp, Artificial Sequence
  Description of Artificial Sequence: Synthetic oligonucleotide
  Target: ANGPTL3; (-) strand; PAM type: NRG; PAM sequence: TAG
tctactaaaaatacaaaaat

SEQ ID NO: 8411 - DNA, 20 bp, Artificial Sequence
  Description of Artificial Sequence: Synthetic oligonucleotide
  Target: ANGPTL3; (-) strand; PAM type: NRG; PAM sequence: CAG
cgaggtcaggagttcgggac

SEQ ID NO: 8412 - DNA, 20 bp, Artificial Sequence
  Description of Artificial Sequence: Synthetic oligonucleotide
  Target: ANGPTL3; (-) strand; PAM type: NRG; PAM sequence: GGG
gatcacgaggtcaggagttc

SEQ ID NO: 8413 - DNA, 20 bp, Artificial Sequence
  Description of Artificial Sequence: Synthetic oligonucleotide
  Target: ANGPTL3; (-) strand; PAM type: NRG; PAM sequence: CGG
ggatcacgaggtcaggagtt

SEQ ID NO: 8414 - DNA, 20 bp, Artificial Sequence
  Description of Artificial Sequence: Synthetic oligonucleotide
  Target: ANGPTL3; (-) strand; PAM type: NRG; PAM sequence: GAG
aaggcggatcacgaggtcag

SEQ ID NO: 8415 - DNA, 20 bp, Artificial Sequence
  Description of Artificial Sequence: Synthetic oligonucleotide
  Target: ANGPTL3; (-) strand; PAM type: NRG; PAM sequence: AGG
ggaaggcggatcacgaggtc

SEQ ID NO: 8416 - DNA, 20 bp, Artificial Sequence
  Description of Artificial Sequence: Synthetic oligonucleotide
  Target: ANGPTL3; (-) strand; PAM type: NRG; PAM sequence: CAG
aggaaggcggatcacgaggt

SEQ ID NO: 8417 - DNA, 20 bp, Artificial Sequence
  Description of Artificial Sequence: Synthetic oligonucleotide
  Target: ANGPTL3; (-) strand; PAM type: NRG; PAM sequence: AGG
gccgaggaaggcggatcacg

SEQ ID NO: 8418 - DNA, 20 bp, Artificial Sequence
  Description of Artificial Sequence: Synthetic oligonucleotide
  Target: ANGPTL3; (-) strand; PAM type: NRG; PAM sequence: GAG
ggccgaggaaggcggatcac

SEQ ID NO: 8419 - DNA, 20 bp, Artificial Sequence
  Description of Artificial Sequence: Synthetic oligonucleotide
  Target: ANGPTL3; (-) strand; PAM type: NRG; PAM sequence: CGG
ctttgggaggccgaggaagg

SEQ ID NO: 8420 - DNA, 20 bp, Artificial Sequence
  Description of Artificial Sequence: Synthetic oligonucleotide
  Target: ANGPTL3; (-) strand; PAM type: NRG; PAM sequence: AGG
gcactttgggaggccgagga

SEQ ID NO: 8421 - DNA, 20 bp, Artificial Sequence
  Description of Artificial Sequence: Synthetic oligonucleotide
  Target: ANGPTL3; (-) strand; PAM type: NRG; PAM sequence: AAG
agcactttgggaggccgagg

SEQ ID NO: 8422 - DNA, 20 bp, Artificial Sequence
  Description of Artificial Sequence: Synthetic oligonucleotide
  Target: ANGPTL3; (-) strand; PAM type: NRG; PAM sequence: AGG
cttagcactttgggaggccg

SEQ ID NO: 8423 - DNA, 20 bp, Artificial Sequence
  Description of Artificial Sequence: Synthetic oligonucleotide
  Target: ANGPTL3; (-) strand; PAM type: NRG; PAM sequence: GAG
tcttagcactttgggaggcc

SEQ ID NO: 8424 - DNA, 20 bp, Artificial Sequence
  Description of Artificial Sequence: Synthetic oligonucleotide
  Target: ANGPTL3; (-) strand; PAM type: NRG; PAM sequence: AGG
tgtaatcttagcactttggg

SEQ ID NO: 8425 - DNA, 20 bp, Artificial Sequence
  Description of Artificial Sequence: Synthetic oligonucleotide
  Target: ANGPTL3; (-) strand; PAM type: NRG; PAM sequence: GAG
ctgtaatcttagcactttgg

SEQ ID NO: 8426 - DNA, 20 bp, Artificial Sequence
  Description of Artificial Sequence: Synthetic oligonucleotide
  Target: ANGPTL3; (-) strand; PAM type: NRG; PAM sequence: GGG
gcctgtaatcttagcacttt

SEQ ID NO: 8427 - DNA, 20 bp, Artificial Sequence
  Description of Artificial Sequence: Synthetic oligonucleotide
  Target: ANGPTL3; (-) strand; PAM type: NRG; PAM sequence: TGG
cgcctgtaatcttagcactt

SEQ ID NO: 8428 - DNA, 20 bp, Artificial Sequence
  Description of Artificial Sequence: Synthetic oligonucleotide
  Target: ANGPTL3; (-) strand; PAM type: NRG; PAM sequence: TAG
ggggctcacgcctgtaatct

SEQ ID NO: 8429 - DNA, 20 bp, Artificial Sequence
  Description of Artificial Sequence: Synthetic oligonucleotide
  Target: ANGPTL3; (-) strand; PAM type: NRG; PAM sequence: GGG
actgagtcggctgggcgcgg

SEQ ID NO: 8430 - DNA, 20 bp, Artificial Sequence
  Description of Artificial Sequence: Synthetic oligonucleotide
  Target: ANGPTL3; (-) strand; PAM type: NRG; PAM sequence: GGG
aactgagtcggctgggcgcg

SEQ ID NO: 8431 - DNA, 20 bp, Artificial Sequence
  Description of Artificial Sequence: Synthetic oligonucleotide
  Target: ANGPTL3; (-) strand; PAM type: NRG; PAM sequence: GGG
aaactgagtcggctgggcgc

SEQ ID NO: 8432 - DNA, 20 bp, Artificial Sequence
  Description of Artificial Sequence: Synthetic oligonucleotide
  Target: ANGPTL3; (-) strand; PAM type: NRG; PAM sequence: CGG
aaaactgagtcggctgggcg

SEQ ID NO: 8433 - DNA, 20 bp, Artificial Sequence
  Description of Artificial Sequence: Synthetic oligonucleotide
  Target: ANGPTL3; (-) strand; PAM type: NRG; PAM sequence: GGG
ctataaaaactgagtcggct

SEQ ID NO: 8434 - DNA, 20 bp, Artificial Sequence
  Description of Artificial Sequence: Synthetic oligonucleotide
  Target: ANGPTL3; (-) strand; PAM type: NRG; PAM sequence: TGG
actataaaaactgagtcggc

SEQ ID NO: 8435 - DNA, 20 bp, Artificial Sequence
  Description of Artificial Sequence: Synthetic oligonucleotide
  Target: ANGPTL3; (-) strand; PAM type: NRG; PAM sequence: CGG
tttaactataaaaactgagt

SEQ ID NO: 8436 - DNA, 20 bp, Artificial Sequence
  Description of Artificial Sequence: Synthetic oligonucleotide
  Target: ANGPTL3; (-) strand; PAM type: NRG; PAM sequence: GAG
ttattttaactataaaaact

SEQ ID NO: 8437 - DNA, 20 bp, Artificial Sequence
  Description of Artificial Sequence: Synthetic oligonucleotide
  Target: ANGPTL3; (-) strand; PAM type: NRG; PAM sequence: TAG
ttattctatcgaattggtcc

SEQ ID NO: 8438 - DNA, 20 bp, Artificial Sequence
  Description of Artificial Sequence: Synthetic oligonucleotide
  Target: ANGPTL3; (-) strand; PAM type: NRG; PAM sequence: TGG
tgagttttattctatcgaat

SEQ ID NO: 8439 - DNA, 20 bp, Artificial Sequence
  Description of Artificial Sequence: Synthetic oligonucleotide
  Target: ANGPTL3; (-) strand; PAM type: NRG; PAM sequence: GAG
tgtccttgttataccactct

SEQ ID NO: 8440 - DNA, 20 bp, Artificial Sequence
  Description of Artificial Sequence: Synthetic oligonucleotide
  Target: ANGPTL3; (-) strand; PAM type: NRG; PAM sequence: TGG
tgccacatactctgctattt

SEQ ID NO: 8441 - DNA, 20 bp, Artificial Sequence
  Description of Artificial Sequence: Synthetic oligonucleotide
  Target: ANGPTL3; (-) strand; PAM type: NRG; PAM sequence: AAG
ttagagttcatagatgtctc

SEQ ID NO: 8442 - DNA, 20 bp, Artificial Sequence
  Description of Artificial Sequence: Synthetic oligonucleotide
  Target: ANGPTL3; (-) strand; PAM type: NRG; PAM sequence: TAG
gtttttatttttagagttca

SEQ ID NO: 8443 - DNA, 20 bp, Artificial Sequence
  Description of Artificial Sequence: Synthetic oligonucleotide
  Target: ANGPTL3; (-) strand; PAM type: NRG; PAM sequence: GAG
ggtttttgtttttattttta

SEQ ID NO: 8444 - DNA, 20 bp, Artificial Sequence
  Description of Artificial Sequence: Synthetic oligonucleotide
  Target: ANGPTL3; (-) strand; PAM type: NRG; PAM sequence: TAG
ttggtttttgtttttatttt

SEQ ID NO: 8445 - DNA, 20 bp, Artificial Sequence
  Description of Artificial Sequence: Synthetic oligonucleotide
  Target: ANGPTL3; (-) strand; PAM type: NRG; PAM sequence: TGG
ttctctgcttcagaaagtat

SEQ ID NO: 8446 - DNA, 20 bp, Artificial Sequence
  Description of Artificial Sequence: Synthetic oligonucleotide
  Target: ANGPTL3; (-) strand; PAM type: NRG; PAM sequence: AAG
gtatggttctctgcttcaga

SEQ ID NO: 8447 - DNA, 20 bp, Artificial Sequence
  Description of Artificial Sequence: Synthetic oligonucleotide
  Target: ANGPTL3; (-) strand; PAM type: NRG; PAM sequence: CAG
aagtgtatggttctctgctt

SEQ ID NO: 8448 - DNA, 20 bp, Artificial Sequence
  Description of Artificial Sequence: Synthetic oligonucleotide
  Target: ANGPTL3; (-) strand; PAM type: NRG; PAM sequence: TGG
tttttttctattcaagtgta

SEQ ID NO: 8449 - DNA, 20 bp, Artificial Sequence
  Description of Artificial Sequence: Synthetic oligonucleotide
  Target: ANGPTL3; (-) strand; PAM type: NRG; PAM sequence: AAG
gagcatttttttttctattc

SEQ ID NO: 8450 - DNA, 20 bp, Artificial Sequence
  Description of Artificial Sequence: Synthetic oligonucleotide
  Target: ANGPTL3; (-) strand; PAM type: NRG; PAM sequence: GAG
gaacgttactgaaaattcag

SEQ ID NO: 8451 - DNA, 20 bp, Artificial Sequence
  Description of Artificial Sequence: Synthetic oligonucleotide
  Target: ANGPTL3; (-) strand; PAM type: NRG; PAM sequence: AGG
ctgaacgttactgaaaattc

SEQ ID NO: 8452 - DNA, 20 bp, Artificial Sequence
  Description of Artificial Sequence: Synthetic oligonucleotide
  Target: ANGPTL3; (-) strand; PAM type: NRG; PAM sequence: CAG
gctgaacgttactgaaaatt

SEQ ID NO: 8453 - DNA, 20 bp, Artificial Sequence
  Description of Artificial Sequence: Synthetic oligonucleotide
  Target: ANGPTL3; (-) strand; PAM type: NRG; PAM sequence: CAG
atttaaggaagtataaattt

SEQ ID NO: 8454 - DNA, 20 bp, Artificial Sequence
  Description of Artificial Sequence: Synthetic oligonucleotide
  Target: ANGPTL3; (-) strand; PAM type: NRG; PAM sequence: AAG
actacattcataatttaagg

SEQ ID NO: 8455 - DNA, 20 bp, Artificial Sequence
  Description of Artificial Sequence: Synthetic oligonucleotide
  Target: ANGPTL3; (-) strand; PAM type: NRG; PAM sequence: AGG
tttactacattcataattta

SEQ ID NO: 8456 - DNA, 20 bp, Artificial Sequence
  Description of Artificial Sequence: Synthetic oligonucleotide
  Target: ANGPTL3; (-) strand; PAM type: NRG; PAM sequence: AAG
gtttactacattcataattt

SEQ ID NO: 8457 - DNA, 20 bp, Artificial Sequence
  Description of Artificial Sequence: Synthetic oligonucleotide
  Target: ANGPTL3; (-) strand; PAM type: NRG; PAM sequence: TGG
actggtaatactgctgtggt

SEQ ID NO: 8458 - DNA, 20 bp, Artificial Sequence
  Description of Artificial Sequence: Synthetic oligonucleotide
  Target: ANGPTL3; (-) strand; PAM type: NRG; PAM sequence: TGG
atatactggtaatactgctg

SEQ ID NO: 8459 - DNA, 20 bp, Artificial Sequence
  Description of Artificial Sequence: Synthetic oligonucleotide
  Target: ANGPTL3; (-) strand; PAM type: NRG; PAM sequence: TGG
aatgacaaaatcttatatac

SEQ ID NO: 8460 - DNA, 20 bp, Artificial Sequence
  Description of Artificial Sequence: Synthetic oligonucleotide
  Target: ANGPTL3; (-) strand; PAM type: NRG; PAM sequence: TAG
tataataataataataataa

SEQ ID NO: 8461 - DNA, 20 bp, Artificial Sequence
  Description of Artificial Sequence: Synthetic oligonucleotide
  Target: ANGPTL3; (-) strand; PAM type: NRG; PAM sequence: AAG
cgcatgtatcccagaactta

SEQ ID NO: 8462 - DNA, 20 bp, Artificial Sequence
  Description of Artificial Sequence: Synthetic oligonucleotide
  Target: ANGPTL3; (-) strand; PAM type: NRG; PAM sequence: CAG
cacgttctgcgcatgtatcc

SEQ ID NO: 8463 - DNA, 20 bp, Artificial Sequence
  Description of Artificial Sequence: Synthetic oligonucleotide
  Target: ANGPTL3; (-) strand; PAM type: NRG; PAM sequence: CAG
agatgacgggttgatgggtg

SEQ ID NO: 8464 - DNA, 20 bp, Artificial Sequence
  Description of Artificial Sequence: Synthetic oligonucleotide
  Target: ANGPTL3; (-) strand; PAM type: NRG; PAM sequence: GGG
aatgtagatgacgggttgat

SEQ ID NO: 8465 - DNA, 20 bp, Artificial Sequence
  Description of Artificial Sequence: Synthetic oligonucleotide
  Target: ANGPTL3; (-) strand; PAM type: NRG; PAM sequence: TGG
taatgtagatgacgggttga

SEQ ID NO: 8466 - DNA, 20 bp, Artificial Sequence
  Description of Artificial Sequence: Synthetic oligonucleotide
  Target: ANGPTL3; (-) strand; PAM type: NRG; PAM sequence: GGG
aaatacctaatgtagatgac

SEQ ID NO: 8467 - DNA, 20 bp, Artificial Sequence
  Description of Artificial Sequence: Synthetic oligonucleotide
  Target: ANGPTL3; (-) strand; PAM type: NRG; PAM sequence: CGG
gaaatacctaatgtagatga

SEQ ID NO: 8468 - DNA, 20 bp, Artificial Sequence
  Description of Artificial Sequence: Synthetic oligonucleotide
  Target: ANGPTL3; (-) strand; PAM type: NRG; PAM sequence: TAG
attaggagaaatacctaatg

SEQ ID NO: 8469 - DNA, 20 bp, Artificial Sequence
  Description of Artificial Sequence: Synthetic oligonucleotide
  Target: ANGPTL3; (-) strand; PAM type: NRG; PAM sequence: GAG
taggggagggatagcattag

SEQ ID NO: 8470 - DNA, 20 bp, Artificial Sequence
  Description of Artificial Sequence: Synthetic oligonucleotide
  Target: ANGPTL3; (-) strand; PAM type: NRG; PAM sequence: AGG
gctaggggagggatagcatt

SEQ ID NO: 8471 - DNA, 20 bp, Artificial Sequence
  Description of Artificial Sequence: Synthetic oligonucleotide
  Target: ANGPTL3; (-) strand; PAM type: NRG; PAM sequence: TAG
ggctaggggagggatagcat

SEQ ID NO: 8472 - DNA, 20 bp, Artificial Sequence
  Description of Artificial Sequence: Synthetic oligonucleotide
  Target: ANGPTL3; (-) strand; PAM type: NRG; PAM sequence: TAG
gggtggggctaggggaggga

SEQ ID NO: 8473 - DNA, 20 bp, Artificial Sequence
  Description of Artificial Sequence: Synthetic oligonucleotide
  Target: ANGPTL3; (-) strand; PAM type: NRG; PAM sequence: GGG
gtcggggtggggctagggga

SEQ ID NO: 8474 - DNA, 20 bp, Artificial Sequence
  Description of Artificial Sequence: Synthetic oligonucleotide
  Target: ANGPTL3; (-) strand; PAM type: NRG; PAM sequence: AGG
tgtcggggtggggctagggg

SEQ ID NO: 8475 - DNA, 20 bp, Artificial Sequence
  Description of Artificial Sequence: Synthetic oligonucleotide
  Target: ANGPTL3; (-) strand; PAM type: NRG; PAM sequence: GAG
ctgtcggggtggggctaggg

SEQ ID NO: 8476 - DNA, 20 bp, Artificial Sequence
  Description of Artificial Sequence: Synthetic oligonucleotide
  Target: ANGPTL3; (-) strand; PAM type: NRG; PAM sequence: GGG
acctgtcggggtggggctag

SEQ ID NO: 8477 - DNA, 20 bp, Artificial Sequence
  Description of Artificial Sequence: Synthetic oligonucleotide
  Target: ANGPTL3; (-) strand; PAM type: NRG; PAM sequence: GGG
gacctgtcggggtggggcta

SEQ ID NO: 8478 - DNA, 20 bp, Artificial Sequence
  Description of Artificial Sequence: Synthetic oligonucleotide
  Target: ANGPTL3; (-) strand; PAM type: NRG; PAM sequence: AGG
ggacctgtcggggtggggct

SEQ ID NO: 8479 - DNA, 20 bp, Artificial Sequence
  Description of Artificial Sequence: Synthetic oligonucleotide
  Target: ANGPTL3; (-) strand; PAM type: NRG; PAM sequence: TAG
gggacctgtcggggtggggc

SEQ ID NO: 8480 - DNA, 20 bp, Artificial Sequence
  Description of Artificial Sequence: Synthetic oligonucleotide
  Target: ANGPTL3; (-) strand; PAM type: NRG; PAM sequence: GGG
cactgggacctgtcggggtg

SEQ ID NO: 8481 - DNA, 20 bp, Artificial Sequence
  Description of Artificial Sequence: Synthetic oligonucleotide
  Target: ANGPTL3; (-) strand; PAM type: NRG; PAM sequence: GGG
acactgggacctgtcggggt

SEQ ID NO: 8482 - DNA, 20 bp, Artificial Sequence
  Description of Artificial Sequence: Synthetic oligonucleotide
  Target: ANGPTL3; (-) strand; PAM type: NRG; PAM sequence: TGG
cacactgggacctgtcgggg

SEQ ID NO: 8483 - DNA, 20 bp, Artificial Sequence
  Description of Artificial Sequence: Synthetic oligonucleotide
  Target: ANGPTL3; (-) strand; PAM type: NRG; PAM sequence: GGG
tcacacactgggacctgtcg

SEQ ID NO: 8484 - DNA, 20 bp, Artificial Sequence
  Description of Artificial Sequence: Synthetic oligonucleotide
  Target: ANGPTL3; (-) strand; PAM type: NRG; PAM sequence: GGG
atcacacactgggacctgtc

SEQ ID NO: 8485 - DNA, 20 bp, Artificial Sequence
  Description of Artificial Sequence: Synthetic oligonucleotide
  Target: ANGPTL3; (-) strand; PAM type: NRG; PAM sequence: CGG
catcacacactgggacctgt

SEQ ID NO: 8486 - DNA, 20 bp, Artificial Sequence
  Description of Artificial Sequence: Synthetic oligonucleotide
  Target: ANGPTL3; (-) strand; PAM type: NRG; PAM sequence: GGG
ggaaaggaacatcacacact

SEQ ID NO: 8487 - DNA, 20 bp, Artificial Sequence
  Description of Artificial Sequence: Synthetic oligonucleotide
  Target: ANGPTL3; (-) strand; PAM type: NRG; PAM sequence: TGG
gggaaaggaacatcacacac

SEQ ID NO: 8488 - DNA, 20 bp, Artificial Sequence
  Description of Artificial Sequence: Synthetic oligonucleotide
  Target: ANGPTL3; (-) strand; PAM type: NRG; PAM sequence: AGG
gaacacatggacacagggaa

SEQ ID NO: 8489 - DNA, 20 bp, Artificial Sequence
  Description of Artificial Sequence: Synthetic oligonucleotide
  Target: ANGPTL3; (-) strand; PAM type: NRG; PAM sequence: AAG
agaacacatggacacaggga

SEQ ID NO: 8490 - DNA, 20 bp, Artificial Sequence
  Description of Artificial Sequence: Synthetic oligonucleotide
  Target: ANGPTL3; (-) strand; PAM type: NRG; PAM sequence: GGG
aatgagaacacatggacaca

SEQ ID NO: 8491 - DNA, 20 bp, Artificial Sequence
  Description of Artificial Sequence: Synthetic oligonucleotide
  Target: ANGPTL3; (-) strand; PAM type: NRG; PAM sequence: AGG
caatgagaacacatggacac

SEQ ID NO: 8492 - DNA, 20 bp, Artificial Sequence
  Description of Artificial Sequence: Synthetic oligonucleotide
  Target: ANGPTL3; (-) strand; PAM type: NRG; PAM sequence: CAG
acaatgagaacacatggaca

SEQ ID NO: 8493 - DNA, 20 bp, Artificial Sequence
  Description of Artificial Sequence: Synthetic oligonucleotide
  Target: ANGPTL3; (-) strand; PAM type: NRG; PAM sequence: TGG
agctaaacaatgagaacaca

SEQ ID NO: 8494 - DNA, 20 bp, Artificial Sequence
  Description of Artificial Sequence: Synthetic oligonucleotide
  Target: ANGPTL3; (-) strand; PAM type: NRG; PAM sequence: GAG
ataagtgggagctaaacaat

SEQ ID NO: 8495 - DNA, 20 bp, Artificial Sequence
  Description of Artificial Sequence: Synthetic oligonucleotide
  Target: ANGPTL3; (-) strand; PAM type: NRG; PAM sequence: GAG
atgttctcactcataagtgg

SEQ ID NO: 8496 - DNA, 20 bp, Artificial Sequence
  Description of Artificial Sequence: Synthetic oligonucleotide
  Target: ANGPTL3; (-) strand; PAM type: NRG; PAM sequence: GGG
acatgttctcactcataagt

SEQ ID NO: 8497 - DNA, 20 bp, Artificial Sequence
  Description of Artificial Sequence: Synthetic oligonucleotide
  Target: ANGPTL3; (-) strand; PAM type: NRG; PAM sequence: TGG
cacatgttctcactcataag

SEQ ID NO: 8498 - DNA, 20 bp, Artificial Sequence
  Description of Artificial Sequence: Synthetic oligonucleotide
  Target: ANGPTL3; (-) strand; PAM type: NRG; PAM sequence: AAG
caccacatgttctcactcat

SEQ ID NO: 8499 - DNA, 20 bp, Artificial Sequence
  Description of Artificial Sequence: Synthetic oligonucleotide
  Target: ANGPTL3; (-) strand; PAM type: NRG; PAM sequence: CAG
tcagcaaactaacacaggaa

SEQ ID NO: 8500 - DNA, 20 bp, Artificial Sequence
  Description of Artificial Sequence: Synthetic oligonucleotide
  Target: ANGPTL3; (-) strand; PAM type: NRG; PAM sequence: AGG
cattctcagcaaactaacac

SEQ ID NO: 8501 - DNA, 20 bp, Artificial Sequence
  Description of Artificial Sequence: Synthetic oligonucleotide
  Target: ANGPTL3; (-) strand; PAM type: NRG; PAM sequence: CAG
tcattctcagcaaactaaca

SEQ ID NO: 8502 - DNA, 20 bp, Artificial Sequence
  Description of Artificial Sequence: Synthetic oligonucleotide
  Target: ANGPTL3; (-) strand; PAM type: NRG; PAM sequence: CAG
aagctggaaaccatcattct

SEQ ID NO: 8503 - DNA, 20 bp, Artificial Sequence
  Description of Artificial Sequence: Synthetic oligonucleotide
  Target: ANGPTL3; (-) strand; PAM type: NRG; PAM sequence: TGG
tgtagggacatggatgaagc

SEQ ID NO: 8504 - DNA, 20 bp, Artificial Sequence
  Description of Artificial Sequence: Synthetic oligonucleotide
  Target: ANGPTL3; (-) strand; PAM type: NRG; PAM sequence: AAG
cctttgtagggacatggatg

SEQ ID NO: 8505 - DNA, 20 bp, Artificial Sequence
  Description of Artificial Sequence: Synthetic oligonucleotide
  Target: ANGPTL3; (-) strand; PAM type: NRG; PAM sequence: TGG
tcatgtcctttgtagggaca

SEQ ID NO: 8506 - DNA, 20 bp, Artificial Sequence
  Description of Artificial Sequence: Synthetic oligonucleotide
  Target: ANGPTL3; (-) strand; PAM type: NRG; PAM sequence: GGG
atgagttcatgtcctttgta

SEQ ID NO: 8507 - DNA, 20 bp, Artificial Sequence
  Description of Artificial Sequence: Synthetic oligonucleotide
  Target: ANGPTL3; (-) strand; PAM type: NRG; PAM sequence: AGG
gatgagttcatgtcctttgt

SEQ ID NO: 8508 - DNA, 20 bp, Artificial Sequence
  Description of Artificial Sequence: Synthetic oligonucleotide
  Target: ANGPTL3; (-) strand; PAM type: NRG; PAM sequence: TAG
ggatgagttcatgtcctttg

SEQ ID NO: 8509 - DNA, 20 bp, Artificial Sequence
  Description of Artificial Sequence: Synthetic oligonucleotide
  Target: ANGPTL3; (-) strand; PAM type: NRG; PAM sequence: GAG
atgcagccataaaaaaggat

SEQ ID NO: 8510 - DNA, 20 bp, Artificial Sequence
  Description of Artificial Sequence: Synthetic oligonucleotide
  Target: ANGPTL3; (-) strand; PAM type: NRG; PAM sequence: AGG
atactatgcagccataaaaa

SEQ ID NO: 8511 - DNA, 20 bp, Artificial Sequence
  Description of Artificial Sequence: Synthetic oligonucleotide
  Target: ANGPTL3; (-) strand; PAM type: NRG; PAM sequence: AAG
aatactatgcagccataaaa

SEQ ID NO: 8512 - DNA, 20 bp, Artificial Sequence
  Description of Artificial Sequence: Synthetic oligonucleotide
  Target: ANGPTL3; (-) strand; PAM type: NRG; PAM sequence: CAG
atacaccatggaatactatg

SEQ ID NO: 8513 - DNA, 20 bp, Artificial Sequence
  Description of Artificial Sequence: Synthetic oligonucleotide
  Target: ANGPTL3; (-) strand; PAM type: NRG; PAM sequence: TGG
aatgtggcacatatacacca

SEQ ID NO: 8514 - DNA, 20 bp, Artificial Sequence
  Description of Artificial Sequence: Synthetic oligonucleotide
  Target: ANGPTL3; (-) strand; PAM type: NRG; PAM sequence: TGG
tagactggatgaagaaaatg

SEQ ID NO: 8515 - DNA, 20 bp, Artificial Sequence
  Description of Artificial Sequence: Synthetic oligonucleotide
  Target: ANGPTL3; (-) strand; PAM type: NRG; PAM sequence: AAG
catcaatgatagactggatg

SEQ ID NO: 8516 - DNA, 20 bp, Artificial Sequence
  Description of Artificial Sequence: Synthetic oligonucleotide
  Target: ANGPTL3; (-) strand; PAM type: NRG; PAM sequence: TGG
aatgcccatcaatgatagac

SEQ ID NO: 8517 - DNA, 20 bp, Artificial Sequence
  Description of Artificial Sequence: Synthetic oligonucleotide
  Target: ANGPTL3; (-) strand; PAM type: NRG; PAM sequence: TAG
acccaaatgcccatcaatga

SEQ ID NO: 8518 - DNA, 20 bp, Artificial Sequence
  Description of Artificial Sequence: Synthetic oligonucleotide
  Target: ANGPTL3; (-) strand; PAM type: NRG; PAM sequence: TGG
tattcacaataacaaagact

SEQ ID NO: 8519 - DNA, 20 bp, Artificial Sequence
  Description of Artificial Sequence: Synthetic oligonucleotide
  Target: ANGPTL3; (-) strand; PAM type: NRG; PAM sequence: AAG
cagcactattcacaataaca

SEQ ID NO: 8520 - DNA, 20 bp, Artificial Sequence
  Description of Artificial Sequence: Synthetic oligonucleotide
  Target: ANGPTL3; (-) strand; PAM type: NRG; PAM sequence: CAG
acatgcacacatgtttattg

SEQ ID NO: 8521 - DNA, 20 bp, Artificial Sequence
  Description of Artificial Sequence: Synthetic oligonucleotide
  Target: ANGPTL3; (-) strand; PAM type: NRG; PAM sequence: AAG
ttataaatcattctactata

SEQ ID NO: 8522 - DNA, 20 bp, Artificial Sequence
  Description of Artificial Sequence: Synthetic oligonucleotide
  Target: ANGPTL3; (-) strand; PAM type: NRG; PAM sequence: AGG
attattgggtatatattcaa

SEQ ID NO: 8523 - DNA, 20 bp, Artificial Sequence
  Description of Artificial Sequence: Synthetic oligonucleotide
  Target: ANGPTL3; (-) strand; PAM type: NRG; PAM sequence: AAG
cattattgggtatatattca

SEQ ID NO: 8524 - DNA, 20 bp, Artificial Sequence
  Description of Artificial Sequence: Synthetic oligonucleotide
  Target: ANGPTL3; (-) strand; PAM type: NRG; PAM sequence: GGG
gacccagtaatcccattatt

SEQ ID NO: 8525 - DNA, 20 bp, Artificial Sequence
  Description of Artificial Sequence: Synthetic oligonucleotide
  Target: ANGPTL3; (-) strand; PAM type: NRG; PAM sequence: TGG
tgacccagtaatcccattat

SEQ ID NO: 8526 - DNA, 20 bp, Artificial Sequence
  Description of Artificial Sequence: Synthetic oligonucleotide
  Target: ANGPTL3; (-) strand; PAM type: NRG; PAM sequence: CAG
actagaaataccatttgacc

SEQ ID NO: 8527 - DNA, 20 bp, Artificial Sequence
  Description of Artificial Sequence: Synthetic oligonucleotide
  Target: ANGPTL3; (-) strand; PAM type: NRG; PAM sequence: TAG
attcctcaaggaactagaac

SEQ ID NO: 8528 - DNA, 20 bp, Artificial Sequence
  Description of Artificial Sequence: Synthetic oligonucleotide
  Target: ANGPTL3; (-) strand; PAM type: NRG; PAM sequence: TAG
gtggcgattcctcaaggaac

SEQ ID NO: 8529 - DNA, 20 bp, Artificial Sequence
  Description of Artificial Sequence: Synthetic oligonucleotide
  Target: ANGPTL3; (-) strand; PAM type: NRG; PAM sequence: AGG
gacagtgtggcgattcctca

SEQ ID NO: 8530 - DNA, 20 bp, Artificial Sequence
  Description of Artificial Sequence: Synthetic oligonucleotide
  Target: ANGPTL3; (-) strand; PAM type: NRG; PAM sequence: AAG
agacagtgtggcgattcctc

SEQ ID NO: 8531 - DNA, 20 bp, Artificial Sequence
  Description of Artificial Sequence: Synthetic oligonucleotide
  Target: ANGPTL3; (-) strand; PAM type: NRG; PAM sequence: TGG
aaccattgtggaagacagtg

SEQ ID NO: 8532 - DNA, 20 bp, Artificial Sequence
  Description of Artificial Sequence: Synthetic oligonucleotide
  Target: ANGPTL3; (-) strand; PAM type: NRG; PAM sequence: CAG
agttcaaccattgtggaaga

SEQ ID NO: 8533 - DNA, 20 bp, Artificial Sequence
  Description of Artificial Sequence: Synthetic oligonucleotide
  Target: ANGPTL3; (-) strand; PAM type: NRG; PAM sequence: AAG
aattagttcaaccattgtgg

SEQ ID NO: 8534 - DNA, 20 bp, Artificial Sequence
  Description of Artificial Sequence: Synthetic oligonucleotide
  Target: ANGPTL3; (-) strand; PAM type: NRG; PAM sequence: TGG
tcaaattagttcaaccattg

SEQ ID NO: 8535 - DNA, 20 bp, Artificial Sequence
  Description of Artificial Sequence: Synthetic oligonucleotide
  Target: ANGPTL3; (-) strand; PAM type: NRG; PAM sequence: TAG
aaaatatgtatgtttcaaat

SEQ ID NO: 8536 - DNA, 20 bp, Artificial Sequence
  Description of Artificial Sequence: Synthetic oligonucleotide
  Target: ANGPTL3; (-) strand; PAM type: NRG; PAM sequence: TAG
atattttgagatgtctataa

SEQ ID NO: 8537 - DNA, 20 bp, Artificial Sequence
  Description of Artificial Sequence: Synthetic oligonucleotide
  Target: ANGPTL3; (-) strand; PAM type: NRG; PAM sequence: GAG
ataagcatcaacaatatttt

SEQ ID NO: 8538 - DNA, 20 bp, Artificial Sequence
  Description of Artificial Sequence: Synthetic oligonucleotide
  Target: ANGPTL3; (-) strand; PAM type: NRG; PAM sequence: AAG
tgtattttctaaatagtaat

SEQ ID NO: 8539 - DNA, 20 bp, Artificial Sequence
  Description of Artificial Sequence: Synthetic oligonucleotide
  Target: ANGPTL3; (-) strand; PAM type: NRG; PAM sequence: TAG
aaactattgtattttctaaa

SEQ ID NO: 8540 - DNA, 20 bp, Artificial Sequence
  Description of Artificial Sequence: Synthetic oligonucleotide
  Target: ANGPTL3; (+) strand; PAM type: NRG; PAM sequence: GAG
aagtgataccataaacgcag

SEQ ID NO: 8541 - DNA, 20 bp, Artificial Sequence
  Description of Artificial Sequence: Synthetic oligonucleotide
  Target: ANGPTL3; (+) strand; PAM type: NRG; PAM sequence: AGG
agtgataccataaacgcagg

SEQ ID NO: 8542 - DNA, 20 bp, Artificial Sequence
  Description of Artificial Sequence: Synthetic oligonucleotide
  Target: ANGPTL3; (+) strand; PAM type: NRG; PAM sequence: AAG
gataccataaacgcaggagg

SEQ ID NO: 8543 - DNA, 20 bp, Artificial Sequence
  Description of Artificial Sequence: Synthetic oligonucleotide
  Target: ANGPTL3; (+) strand; PAM type: NRG; PAM sequence: AAG
tgtttgttatatatataaca

SEQ ID NO: 8544 - DNA, 20 bp, Artificial Sequence
  Description of Artificial Sequence: Synthetic oligonucleotide
  Target: ANGPTL3; (+) strand; PAM type: NRG; PAM sequence: TAG
ttatatatataacaaagaat

SEQ ID NO: 8545 - DNA, 20 bp, Artificial Sequence
  Description of Artificial Sequence: Synthetic oligonucleotide
  Target: ANGPTL3; (+) strand; PAM type: NRG; PAM sequence: TAG
atgtaaataattcctaaaat

SEQ ID NO: 8546 - DNA, 20 bp, Artificial Sequence
  Description of Artificial Sequence: Synthetic oligonucleotide
  Target: ANGPTL3; (+) strand; PAM type: NRG; PAM sequence: CAG
aaataattcctaaaattagt

SEQ ID NO: 8547 - DNA, 20 bp, Artificial Sequence
  Description of Artificial Sequence: Synthetic oligonucleotide
  Target: ANGPTL3; (+) strand; PAM type: NRG; PAM sequence: AAG
aattcctaaaattagtcaga

SEQ ID NO: 8548 - DNA, 20 bp, Artificial Sequence
  Description of Artificial Sequence: Synthetic oligonucleotide
  Target: ANGPTL3; (+) strand; PAM type: NRG; PAM sequence: GAG
ttcctaaaattagtcagaaa

SEQ ID NO: 8549 - DNA, 20 bp, Artificial Sequence
  Description of Artificial Sequence: Synthetic oligonucleotide
  Target: ANGPTL3; (+) strand; PAM type: NRG; PAM sequence: AAG
cagaaagagacaaacttaaa

SEQ ID NO: 8550 - DNA, 20 bp, Artificial Sequence
  Description of Artificial Sequence: Synthetic oligonucleotide
  Target: ANGPTL3; (+) strand; PAM type: NRG; PAM sequence: GAG
gaaagagacaaacttaaaaa

SEQ ID NO: 8551 - DNA, 20 bp, Artificial Sequence
  Description of Artificial Sequence: Synthetic oligonucleotide
  Target: ANGPTL3; (+) strand; PAM type: NRG; PAM sequence: AGG
aaagagacaaacttaaaaag

SEQ ID NO: 8552 - DNA, 20 bp, Artificial Sequence
  Description of Artificial Sequence: Synthetic oligonucleotide
  Target: ANGPTL3; (+) strand; PAM type: NRG; PAM sequence: GGG
aagagacaaacttaaaaaga

SEQ ID NO: 8553 - DNA, 20 bp, Artificial Sequence
  Description of Artificial Sequence: Synthetic oligonucleotide
  Target: ANGPTL3; (+) strand; PAM type: NRG; PAM sequence: AAG
aaacttaaaaagagggtaac

SEQ ID NO: 8554 - DNA, 20 bp, Artificial Sequence
  Description of Artificial Sequence: Synthetic oligonucleotide
  Target: ANGPTL3; (+) strand; PAM type: NRG; PAM sequence: AGG
aacttaaaaagagggtaaca

SEQ ID NO: 8555 - DNA, 20 bp, Artificial Sequence
  Description of Artificial Sequence: Synthetic oligonucleotide
  Target: ANGPTL3; (+) strand; PAM type: NRG; PAM sequence: GAG
cttaaaaagagggtaacaag

SEQ ID NO: 8556 - DNA, 20 bp, Artificial Sequence
  Description of Artificial Sequence: Synthetic oligonucleotide
  Target: ANGPTL3; (+) strand; PAM type: NRG; PAM sequence: AGG
ttaaaaagagggtaacaagg

SEQ ID NO: 8557 - DNA, 20 bp, Artificial Sequence
  Description of Artificial Sequence: Synthetic oligonucleotide
  Target: ANGPTL3; (+) strand; PAM type: NRG; PAM sequence: GGG
taaaaagagggtaacaagga

SEQ ID NO: 8558 - DNA, 20 bp, Artificial Sequence
  Description of Artificial Sequence: Synthetic oligonucleotide
  Target: ANGPTL3; (+) strand; PAM type: NRG; PAM sequence: GGG
aaaaagagggtaacaaggag

SEQ ID NO: 8559 - DNA, 20 bp, Artificial Sequence
  Description of Artificial Sequence: Synthetic oligonucleotide
  Target: ANGPTL3; (+) strand; PAM type: NRG; PAM sequence: GAG
aaagagggtaacaaggaggg

SEQ ID NO: 8560 - DNA, 20 bp, Artificial Sequence
  Description of Artificial Sequence: Synthetic oligonucleotide
  Target: ANGPTL3; (+) strand; PAM type: NRG; PAM sequence: CAG
gagcaaattatgtacataac

SEQ ID NO: 8561 - DNA, 20 bp, Artificial Sequence
  Description of Artificial Sequence: Synthetic oligonucleotide
  Target: ANGPTL3; (+) strand; PAM type: NRG; PAM sequence: AAG
acataaccagatgattcgca

SEQ ID NO: 8562 - DNA, 20 bp, Artificial Sequence
  Description of Artificial Sequence: Synthetic oligonucleotide
  Target: ANGPTL3; (+) strand; PAM type: NRG; PAM sequence: CGG
aaccagatgattcgcaaaga

SEQ ID NO: 8563 - DNA, 20 bp, Artificial Sequence
  Description of Artificial Sequence: Synthetic oligonucleotide
  Target: ANGPTL3; (+) strand; PAM type: NRG; PAM sequence: CAG
atgattcgcaaagacggcaa

SEQ ID NO: 8564 - DNA, 20 bp, Artificial Sequence
  Description of Artificial Sequence: Synthetic oligonucleotide
  Target: ANGPTL3; (+) strand; PAM type: NRG; PAM sequence: GAG
gattcgcaaagacggcaaca

SEQ ID NO: 8565 - DNA, 20 bp, Artificial Sequence
  Description of Artificial Sequence: Synthetic oligonucleotide
  Target: ANGPTL3; (+) strand; PAM type: NRG; PAM sequence: TGG
cgcaaagacggcaacagaga

SEQ ID NO: 8566 - DNA, 20 bp, Artificial Sequence
  Description of Artificial Sequence: Synthetic oligonucleotide
  Target: ANGPTL3; (+) strand; PAM type: NRG; PAM sequence: CAG
aagacggcaacagagatggc

SEQ ID NO: 8567 - DNA, 20 bp, Artificial Sequence
  Description of Artificial Sequence: Synthetic oligonucleotide
  Target: ANGPTL3; (+) strand; PAM type: NRG; PAM sequence: TAG
agatggccagcaaaacaaac

SEQ ID NO: 8568 - DNA, 20 bp, Artificial Sequence
  Description of Artificial Sequence: Synthetic oligonucleotide
  Target: ANGPTL3; (+) strand; PAM type: NRG; PAM sequence: TAG
ctagatatatacttgtctat

SEQ ID NO: 8569 - DNA, 20 bp, Artificial Sequence
  Description of Artificial Sequence: Synthetic oligonucleotide
  Target: ANGPTL3; (+) strand; PAM type: NRG; PAM sequence: AAG
ttttttgcctttttcattaa

SEQ ID NO: 8570 - DNA, 20 bp, Artificial Sequence
  Description of Artificial Sequence: Synthetic oligonucleotide
  Target: ANGPTL3; (+) strand; PAM type: NRG; PAM sequence: AAG
ttcattaaaagcatttgtaa

SEQ ID NO: 8571 - DNA, 20 bp, Artificial Sequence
  Description of Artificial Sequence: Synthetic oligonucleotide
  Target: ANGPTL3; (+) strand; PAM type: NRG; PAM sequence: AGG
tcattaaaagcatttgtaaa

SEQ ID NO: 8572 - DNA, 20 bp, Artificial Sequence
  Description of Artificial Sequence: Synthetic oligonucleotide
  Target: ANGPTL3; (+) strand; PAM type: NRG; PAM sequence: TAG
aaagcatttgtaaaaggata

SEQ ID NO: 8573 - DNA, 20 bp, Artificial Sequence
  Description of Artificial Sequence: Synthetic oligonucleotide
  Target: ANGPTL3; (+) strand; PAM type: NRG; PAM sequence: AGG
aagcatttgtaaaaggatat

SEQ ID NO: 8574 - DNA, 20 bp, Artificial Sequence
  Description of Artificial Sequence: Synthetic oligonucleotide
  Target: ANGPTL3; (+) strand; PAM type: NRG; PAM sequence: AAG
tttgtaaaaggatataggaa

SEQ ID NO: 8575 - DNA, 20 bp, Artificial Sequence
  Description of Artificial Sequence: Synthetic oligonucleotide
  Target: ANGPTL3; (+) strand; PAM type: NRG; PAM sequence: GAG
tgtaaaaggatataggaaaa

SEQ ID NO: 8576 - DNA, 20 bp, Artificial Sequence
  Description of Artificial Sequence: Synthetic oligonucleotide
  Target: ANGPTL3; (+) strand; PAM type: NRG; PAM sequence: AGG
gtaaaaggatataggaaaag

SEQ ID NO: 8577 - DNA, 20 bp, Artificial Sequence
  Description of Artificial Sequence: Synthetic oligonucleotide
  Target: ANGPTL3; (+) strand; PAM type: NRG; PAM sequence: TGG
gaggaactctcatatactcc

SEQ ID NO: 8578 - DNA, 20 bp, Artificial Sequence
  Description of Artificial Sequence: Synthetic oligonucleotide
  Target: ANGPTL3; (+) strand; PAM type: NRG; PAM sequence: CAG
gaactctcatatactcctgg

SEQ ID NO: 8579 - DNA, 20 bp, Artificial Sequence
  Description of Artificial Sequence: Synthetic oligonucleotide
  Target: ANGPTL3; (+) strand; PAM type: NRG; PAM sequence: AGG
aactctcatatactcctggc

SEQ ID NO: 8580 - DNA, 20 bp, Artificial Sequence
  Description of Artificial Sequence: Synthetic oligonucleotide
  Target: ANGPTL3; (+) strand; PAM type: NRG; PAM sequence: GGG
actctcatatactcctggca

SEQ ID NO: 8581 - DNA, 20 bp, Artificial Sequence
  Description of Artificial Sequence: Synthetic oligonucleotide
  Target: ANGPTL3; (+) strand; PAM type: NRG; PAM sequence: TGG
ctcctggcagggatgtaaat

SEQ ID NO: 8582 - DNA, 20 bp, Artificial Sequence
  Description of Artificial Sequence: Synthetic oligonucleotide
  Target: ANGPTL3; (+) strand; PAM type: NRG; PAM sequence: AAG
aaattggtacaacccttttg

SEQ ID NO: 8583 - DNA, 20 bp, Artificial Sequence
  Description of Artificial Sequence: Synthetic oligonucleotide
  Target: ANGPTL3; (+) strand; PAM type: NRG; PAM sequence: AGG
aattggtacaacccttttga

SEQ ID NO: 8584 - DNA, 20 bp, Artificial Sequence
  Description of Artificial Sequence: Synthetic oligonucleotide
  Target: ANGPTL3; (+) strand; PAM type: NRG; PAM sequence: AAG
tttgaaggacaatctgacaa

SEQ ID NO: 8585 - DNA, 20 bp, Artificial Sequence
  Description of Artificial Sequence: Synthetic oligonucleotide
  Target: ANGPTL3; (+) strand; PAM type: NRG; PAM sequence: AAG
aatctgacaaaagcaatcgt

SEQ ID NO: 8586 - DNA, 20 bp, Artificial Sequence
  Description of Artificial Sequence: Synthetic oligonucleotide
  Target: ANGPTL3; (+) strand; PAM type: NRG; PAM sequence: AAG
caaaagcaatcgtaagttac

SEQ ID NO: 8587 - DNA, 20 bp, Artificial Sequence
  Description of Artificial Sequence: Synthetic oligonucleotide
  Target: ANGPTL3; (+) strand; PAM type: NRG; PAM sequence: AAG
tacatacatcaccaccataa

SEQ ID NO: 8588 - DNA, 20 bp, Artificial Sequence
  Description of Artificial Sequence: Synthetic oligonucleotide
  Target: ANGPTL3; (+) strand; PAM type: NRG; PAM sequence: TAG
ctatacatactgtttataat

SEQ ID NO: 8589 - DNA, 20 bp, Artificial Sequence
  Description of Artificial Sequence: Synthetic oligonucleotide
  Target: ANGPTL3; (+) strand; PAM type: NRG; PAM sequence: TGG
actgtttataattagaaaat

SEQ ID NO: 8590 - DNA, 20 bp, Artificial Sequence
  Description of Artificial Sequence: Synthetic oligonucleotide
  Target: ANGPTL3; (+) strand; PAM type: NRG; PAM sequence: AAG
aattggaaacaaatgattaa

SEQ ID NO: 8591 - DNA, 20 bp, Artificial Sequence
  Description of Artificial Sequence: Synthetic oligonucleotide
  Target: ANGPTL3; (+) strand; PAM type: NRG; PAM sequence: AGG
attggaaacaaatgattaaa

SEQ ID NO: 8592 - DNA, 20 bp, Artificial Sequence
  Description of Artificial Sequence: Synthetic oligonucleotide
  Target: ANGPTL3; (+) strand; PAM type: NRG; PAM sequence: GGG
ttggaaacaaatgattaaaa

SEQ ID NO: 8593 - DNA, 20 bp, Artificial Sequence
  Description of Artificial Sequence: Synthetic oligonucleotide
  Target: ANGPTL3; (+) strand; PAM type: NRG; PAM sequence: GGG
tggaaacaaatgattaaaag

SEQ ID NO: 8594 - DNA, 20 bp, Artificial Sequence
  Description of Artificial Sequence: Synthetic oligonucleotide
  Target: ANGPTL3; (+) strand; PAM type: NRG; PAM sequence: GGG
ggaaacaaatgattaaaagg

SEQ ID NO: 8595 - DNA, 20 bp, Artificial Sequence
  Description of Artificial Sequence: Synthetic oligonucleotide
  Target: ANGPTL3; (+) strand; PAM type: NRG; PAM sequence: AAG
aaaagggggctgattaaatt

SEQ ID NO: 8596 - DNA, 20 bp, Artificial Sequence
  Description of Artificial Sequence: Synthetic oligonucleotide
  Target: ANGPTL3; (+) strand; PAM type: NRG; PAM sequence: AGG
aaagggggctgattaaatta

SEQ ID NO: 8597 - DNA, 20 bp, Artificial Sequence
  Description of Artificial Sequence: Synthetic oligonucleotide
  Target: ANGPTL3; (+) strand; PAM type: NRG; PAM sequence: CAG
attaaggttcatctatataa

SEQ ID NO: 8598 - DNA, 20 bp, Artificial Sequence
  Description of Artificial Sequence: Synthetic oligonucleotide
  Target: ANGPTL3; (+) strand; PAM type: NRG; PAM sequence: AGG
ttaaggttcatctatataac

SEQ ID NO: 8599 - DNA, 20 bp, Artificial Sequence
  Description of Artificial Sequence: Synthetic oligonucleotide
  Target: ANGPTL3; (+) strand; PAM type: NRG; PAM sequence: CAG
atctatataacaggattatg

SEQ ID NO: 8600 - DNA, 20 bp, Artificial Sequence
  Description of Artificial Sequence: Synthetic oligonucleotide
  Target: ANGPTL3; (+) strand; PAM type: NRG; PAM sequence: AAG
aggattatgcagctattaaa

SEQ ID NO: 8601 - DNA, 20 bp, Artificial Sequence
  Description of Artificial Sequence: Synthetic oligonucleotide
  Target: ANGPTL3; (+) strand; PAM type: NRG; PAM sequence: AGG
ggattatgcagctattaaaa

SEQ ID NO: 8602 - DNA, 20 bp, Artificial Sequence
  Description of Artificial Sequence: Synthetic oligonucleotide
  Target: ANGPTL3; (+) strand; PAM type: NRG; PAM sequence: TGG
tgcagctattaaaaaggacg

SEQ ID NO: 8603 - DNA, 20 bp, Artificial Sequence
  Description of Artificial Sequence: Synthetic oligonucleotide
  Target: ANGPTL3; (+) strand; PAM type: NRG; PAM sequence: TAG
aaaaggacgtggtaactcta

SEQ ID NO: 8604 - DNA, 20 bp, Artificial Sequence
  Description of Artificial Sequence: Synthetic oligonucleotide
  Target: ANGPTL3; (+) strand; PAM type: NRG; PAM sequence: TAG
ggtaactctatagacattca

SEQ ID NO: 8605 - DNA, 20 bp, Artificial Sequence
  Description of Artificial Sequence: Synthetic oligonucleotide
  Target: ANGPTL3; (+) strand; PAM type: NRG; PAM sequence: AGG
gtaactctatagacattcat

SEQ ID NO: 8606 - DNA, 20 bp, Artificial Sequence
  Description of Artificial Sequence: Synthetic oligonucleotide
  Target: ANGPTL3; (+) strand; PAM type: NRG; PAM sequence: AAG
aaaataaattttaaaatact

SEQ ID NO: 8607 - DNA, 20 bp, Artificial Sequence
  Description of Artificial Sequence: Synthetic oligonucleotide
  Target: ANGPTL3; (+) strand; PAM type: NRG; PAM sequence: GAG
ctgaatgatatatatatcat

SEQ ID NO: 8608 - DNA, 20 bp, Artificial Sequence
  Description of Artificial Sequence: Synthetic oligonucleotide
  Target: ANGPTL3; (+) strand; PAM type: NRG; PAM sequence: AAG
catgagctattatacataac

SEQ ID NO: 8609 - DNA, 20 bp, Artificial Sequence
  Description of Artificial Sequence: Synthetic oligonucleotide
  Target: ANGPTL3; (+) strand; PAM type: NRG; PAM sequence: TAG
gtgttataaaaaattatgtt

SEQ ID NO: 8610 - DNA, 20 bp, Artificial Sequence
  Description of Artificial Sequence: Synthetic oligonucleotide
  Target: ANGPTL3; (+) strand; PAM type: NRG; PAM sequence: AAG
aaattatgtttagtcattca

SEQ ID NO: 8611 - DNA, 20 bp, Artificial Sequence
  Description of Artificial Sequence: Synthetic oligonucleotide
  Target: ANGPTL3; (+) strand; PAM type: NRG; PAM sequence: AGG
aattatgtttagtcattcaa

SEQ ID NO: 8612 - DNA, 20 bp, Artificial Sequence
  Description of Artificial Sequence: Synthetic oligonucleotide
  Target: ANGPTL3; (+) strand; PAM type: NRG; PAM sequence: GGG
attatgtttagtcattcaaa

SEQ ID NO: 8613 - DNA, 20 bp, Artificial Sequence
  Description of Artificial Sequence: Synthetic oligonucleotide
  Target: ANGPTL3; (+) strand; PAM type: NRG; PAM sequence: TGG
gtttagtcattcaaagggtc

SEQ ID NO: 8614 - DNA, 20 bp, Artificial Sequence
  Description of Artificial Sequence: Synthetic oligonucleotide
  Target: ANGPTL3; (+) strand; PAM type: NRG; PAM sequence: TAG
attcaaagggtctggtatga

SEQ ID NO: 8615 - DNA, 20 bp, Artificial Sequence
  Description of Artificial Sequence: Synthetic oligonucleotide
  Target: ANGPTL3; (+) strand; PAM type: NRG; PAM sequence: TAG
tgatagacccaaaatgttaa

SEQ ID NO: 8616 - DNA, 20 bp, Artificial Sequence
  Description of Artificial Sequence: Synthetic oligonucleotide
  Target: ANGPTL3; (+) strand; PAM type: NRG; PAM sequence: GAG
atagacccaaaatgttaata

SEQ ID NO: 8617 - DNA, 20 bp, Artificial Sequence
  Description of Artificial Sequence: Synthetic oligonucleotide
  Target: ANGPTL3; (+) strand; PAM type: NRG; PAM sequence: GAG
cccaaaatgttaatagagtc

SEQ ID NO: 8618 - DNA, 20 bp, Artificial Sequence
  Description of Artificial Sequence: Synthetic oligonucleotide
  Target: ANGPTL3; (+) strand; PAM type: NRG; PAM sequence: TAG
gtcgagatttttatttttta

SEQ ID NO: 8619 - DNA, 20 bp, Artificial Sequence
  Description of Artificial Sequence: Synthetic oligonucleotide
  Target: ANGPTL3; (+) strand; PAM type: NRG; PAM sequence: AGG
tcgagatttttattttttat

SEQ ID NO: 8620 - DNA, 20 bp, Artificial Sequence
  Description of Artificial Sequence: Synthetic oligonucleotide
  Target: ANGPTL3; (+) strand; PAM type: NRG; PAM sequence: AAG
aatacctgaattttcacaat

SEQ ID NO: 8621 - DNA, 20 bp, Artificial Sequence
  Description of Artificial Sequence: Synthetic oligonucleotide
  Target: ANGPTL3; (+) strand; PAM type: NRG; PAM sequence: TAG
actttgcacattaaaaatct

SEQ ID NO: 8622 - DNA, 20 bp, Artificial Sequence
  Description of Artificial Sequence: Synthetic oligonucleotide
  Target: ANGPTL3; (+) strand; PAM type: NRG; PAM sequence: TGG
tgcacattaaaaatcttagc

SEQ ID NO: 8623 - DNA, 20 bp, Artificial Sequence
  Description of Artificial Sequence: Synthetic oligonucleotide
  Target: ANGPTL3; (+) strand; PAM type: NRG; PAM sequence: GGG
gcacattaaaaatcttagct

SEQ ID NO: 8624 - DNA, 20 bp, Artificial Sequence
  Description of Artificial Sequence: Synthetic oligonucleotide
  Target: ANGPTL3; (+) strand; PAM type: NRG; PAM sequence: TGG
ttaaaaatcttagctgggca

SEQ ID NO: 8625 - DNA, 20 bp, Artificial Sequence
  Description of Artificial Sequence: Synthetic oligonucleotide
  Target: ANGPTL3; (+) strand; PAM type: NRG; PAM sequence: TGG
aaaatcttagctgggcatgg

SEQ ID NO: 8626 - DNA, 20 bp, Artificial Sequence
  Description of Artificial Sequence: Synthetic oligonucleotide
  Target: ANGPTL3; (+) strand; PAM type: NRG; PAM sequence: CAG
gtggctcacgcttgtaatcc

SEQ ID NO: 8627 - DNA, 20 bp, Artificial Sequence
  Description of Artificial Sequence: Synthetic oligonucleotide
  Target: ANGPTL3; (+) strand; PAM type: NRG; PAM sequence: TGG
cgcttgtaatcccagcactc

SEQ ID NO: 8628 - DNA, 20 bp, Artificial Sequence
  Description of Artificial Sequence: Synthetic oligonucleotide
  Target: ANGPTL3; (+) strand; PAM type: NRG; PAM sequence: GGG
gcttgtaatcccagcactct

SEQ ID NO: 8629 - DNA, 20 bp, Artificial Sequence
  Description of Artificial Sequence: Synthetic oligonucleotide
  Target: ANGPTL3; (+) strand; PAM type: NRG; PAM sequence: GAG
ttgtaatcccagcactctgg

SEQ ID NO: 8630 - DNA, 20 bp, Artificial Sequence
  Description of Artificial Sequence: Synthetic oligonucleotide
  Target: ANGPTL3; (+) strand; PAM type: NRG; PAM sequence: AGG
tgtaatcccagcactctggg

SEQ ID NO: 8631 - DNA, 20 bp, Artificial Sequence
  Description of Artificial Sequence: Synthetic oligonucleotide
  Target: ANGPTL3; (+) strand; PAM type: NRG; PAM sequence: AAG
tcccagcactctgggaggcc

SEQ ID NO: 8632 - DNA, 20 bp, Artificial Sequence
  Description of Artificial Sequence: Synthetic oligonucleotide
  Target: ANGPTL3; (+) strand; PAM type: NRG; PAM sequence: AGG
cccagcactctgggaggcca

SEQ ID NO: 8633 - DNA, 20 bp, Artificial Sequence
  Description of Artificial Sequence: Synthetic oligonucleotide
  Target: ANGPTL3; (+) strand; PAM type: NRG; PAM sequence: TAG
agcactctgggaggccaagg

SEQ ID NO: 8634 - DNA, 20 bp, Artificial Sequence
  Description of Artificial Sequence: Synthetic oligonucleotide
  Target: ANGPTL3; (+) strand; PAM type: NRG; PAM sequence: AGG
gcactctgggaggccaaggt

SEQ ID NO: 8635 - DNA, 20 bp, Artificial Sequence
  Description of Artificial Sequence: Synthetic oligonucleotide
  Target: ANGPTL3; (+) strand; PAM type: NRG; PAM sequence: CAG
ctctgggaggccaaggtagg

SEQ ID NO: 8636 - DNA, 20 bp, Artificial Sequence
  Description of Artificial Sequence: Synthetic oligonucleotide
  Target: ANGPTL3; (+) strand; PAM type: NRG; PAM sequence: GAG
ccaaggtaggcagatcacct

SEQ ID NO: 8637 - DNA, 20 bp, Artificial Sequence
  Description of Artificial Sequence: Synthetic oligonucleotide
  Target: ANGPTL3; (+) strand; PAM type: NRG; PAM sequence: AGG
caaggtaggcagatcacctg

SEQ ID NO: 8638 - DNA, 20 bp, Artificial Sequence
  Description of Artificial Sequence: Synthetic oligonucleotide
  Target: ANGPTL3; (+) strand; PAM type: NRG; PAM sequence: CAG
gtaggcagatcacctgaggt

SEQ ID NO: 8639 - DNA, 20 bp, Artificial Sequence
  Description of Artificial Sequence: Synthetic oligonucleotide
  Target: ANGPTL3; (+) strand; PAM type: NRG; PAM sequence: AGG
taggcagatcacctgaggtc

SEQ ID NO: 8640 - DNA, 20 bp, Artificial Sequence
  Description of Artificial Sequence: Synthetic oligonucleotide
  Target: ANGPTL3; (+) strand; PAM type: NRG; PAM sequence: GAG
ggcagatcacctgaggtcag

SEQ ID NO: 8641 - DNA, 20 bp, Artificial Sequence
  Description of Artificial Sequence: Synthetic oligonucleotide
  Target: ANGPTL3; (+) strand; PAM type: NRG; PAM sequence: GAG
tcacctgaggtcaggagttc

SEQ ID NO: 8642 - DNA, 20 bp, Artificial Sequence
  Description of Artificial Sequence: Synthetic oligonucleotide
  Target: ANGPTL3; (+) strand; PAM type: NRG; PAM sequence: CAG
tgaggtcaggagttcgagac

SEQ ID NO: 8643 - DNA, 20 bp, Artificial Sequence
  Description of Artificial Sequence: Synthetic oligonucleotide
  Target: ANGPTL3; (+) strand; PAM type: NRG; PAM sequence: TGG
tcaggagttcgagaccagtc

SEQ ID NO: 8644 - DNA, 20 bp, Artificial Sequence
  Description of Artificial Sequence: Synthetic oligonucleotide
  Target: ANGPTL3; (+) strand; PAM type: NRG; PAM sequence: TGG
cgagaccagtctggccaaca

SEQ ID NO: 8645 - DNA, 20 bp, Artificial Sequence
  Description of Artificial Sequence: Synthetic oligonucleotide
  Target: ANGPTL3; (+) strand; PAM type: NRG; PAM sequence: TAG
tctactaaaaatacaaaaat

SEQ ID NO: 8646 - DNA, 20 bp, Artificial Sequence
  Description of Artificial Sequence: Synthetic oligonucleotide
  Target: ANGPTL3; (+) strand; PAM type: NRG; PAM sequence: CAG
ctaaaaatacaaaaattagc

SEQ ID NO: 8647 - DNA, 20 bp, Artificial Sequence
  Description of Artificial Sequence: Synthetic oligonucleotide
  Target: ANGPTL3; (+) strand; PAM type: NRG; PAM sequence: AGG
taaaaatacaaaaattagcc

SEQ ID NO: 8648 - DNA, 20 bp, Artificial Sequence
  Description of Artificial Sequence: Synthetic oligonucleotide
  Target: ANGPTL3; (+) strand; PAM type: NRG; PAM sequence: TGG
atacaaaaattagccaggct

SEQ ID NO: 8649 - DNA, 20 bp, Artificial Sequence
  Description of Artificial Sequence: Synthetic oligonucleotide
  Target: ANGPTL3; (+) strand; PAM type: NRG; PAM sequence: TGG
aaaaattagccaggcttggt

SEQ ID NO: 8650 - DNA, 20 bp, Artificial Sequence
  Description of Artificial Sequence: Synthetic oligonucleotide
  Target: ANGPTL3; (+) strand; PAM type: NRG; PAM sequence: GGG
aaaattagccaggcttggtt

SEQ ID NO: 8651 - DNA, 20 bp, Artificial Sequence
  Description of Artificial Sequence: Synthetic oligonucleotide
  Target: ANGPTL3; (+) strand; PAM type: NRG; PAM sequence: GGG
aaattagccaggcttggttg

SEQ ID NO: 8652 - DNA, 20 bp, Artificial Sequence
  Description of Artificial Sequence: Synthetic oligonucleotide
  Target: ANGPTL3; (+) strand; PAM type: NRG; PAM sequence: GGG
aattagccaggcttggttgg

SEQ ID NO: 8653 - DNA, 20 bp, Artificial Sequence
  Description of Artificial Sequence: Synthetic oligonucleotide
  Target: ANGPTL3; (+) strand; PAM type: NRG; PAM sequence: CAG
gttgggggtgcctgtaattc

SEQ ID NO: 8654 - DNA, 20 bp, Artificial Sequence
  Description of Artificial Sequence: Synthetic oligonucleotide
  Target: ANGPTL3; (+) strand; PAM type: NRG; PAM sequence: CGG
tgcctgtaattccagatact

SEQ ID NO: 8655 - DNA, 20 bp, Artificial Sequence
  Description of Artificial Sequence: Synthetic oligonucleotide
  Target: ANGPTL3; (+) strand; PAM type: NRG; PAM sequence: GGG
gcctgtaattccagatactc

SEQ ID NO: 8656 - DNA, 20 bp, Artificial Sequence
  Description of Artificial Sequence: Synthetic oligonucleotide
  Target: ANGPTL3; (+) strand; PAM type: NRG; PAM sequence: AAG
tgtaattccagatactcggg

SEQ ID NO: 8657 - DNA, 20 bp, Artificial Sequence
  Description of Artificial Sequence: Synthetic oligonucleotide
  Target: ANGPTL3; (+) strand; PAM type: NRG; PAM sequence: GAG
ttccagatactcgggaagct

SEQ ID NO: 8658 - DNA, 20 bp, Artificial Sequence
  Description of Artificial Sequence: Synthetic oligonucleotide
  Target: ANGPTL3; (+) strand; PAM type: NRG; PAM sequence: CAG
agatactcgggaagctgaga

SEQ ID NO: 8659 - DNA, 20 bp, Artificial Sequence
  Description of Artificial Sequence: Synthetic oligonucleotide
  Target: ANGPTL3; (+) strand; PAM type: NRG; PAM sequence: AGG
gatactcgggaagctgagac

SEQ ID NO: 8660 - DNA, 20 bp, Artificial Sequence
  Description of Artificial Sequence: Synthetic oligonucleotide
  Target: ANGPTL3; (+) strand; PAM type: NRG; PAM sequence: GAG
tactcgggaagctgagacag

SEQ ID NO: 8661 - DNA, 20 bp, Artificial Sequence
  Description of Artificial Sequence: Synthetic oligonucleotide
  Target: ANGPTL3; (+) strand; PAM type: NRG; PAM sequence: CAG
acaggagaatcgcttgaacc

SEQ ID NO: 8662 - DNA, 20 bp, Artificial Sequence
  Description of Artificial Sequence: Synthetic oligonucleotide
  Target: ANGPTL3; (+) strand; PAM type: NRG; PAM sequence: AGG
caggagaatcgcttgaaccc

SEQ ID NO: 8663 - DNA, 20 bp, Artificial Sequence
  Description of Artificial Sequence: Synthetic oligonucleotide
  Target: ANGPTL3; (+) strand; PAM type: NRG; PAM sequence: GAG
ggagaatcgcttgaacccag

SEQ ID NO: 8664 - DNA, 20 bp, Artificial Sequence
  Description of Artificial Sequence: Synthetic oligonucleotide
  Target: ANGPTL3; (+) strand; PAM type: NRG; PAM sequence: AGG
gagaatcgcttgaacccagg

SEQ ID NO: 8665 - DNA, 20 bp, Artificial Sequence
  Description of Artificial Sequence: Synthetic oligonucleotide
  Target: ANGPTL3; (+) strand; PAM type: NRG; PAM sequence: GGG
agaatcgcttgaacccagga

SEQ ID NO: 8666 - DNA, 20 bp, Artificial Sequence
  Description of Artificial Sequence: Synthetic oligonucleotide
  Target: ANGPTL3; (+) strand; PAM type: NRG; PAM sequence: GGG
gaatcgcttgaacccaggag

SEQ ID NO: 8667 - DNA, 20 bp, Artificial Sequence
  Description of Artificial Sequence: Synthetic oligonucleotide
  Target: ANGPTL3; (+) strand; PAM type: NRG; PAM sequence: GGG
aatcgcttgaacccaggagg

SEQ ID NO: 8668 - DNA, 20 bp, Artificial Sequence
  Description of Artificial Sequence: Synthetic oligonucleotide
  Target: ANGPTL3; (+) strand; PAM type: NRG; PAM sequence: AAG
cgcttgaacccaggaggggg

SEQ ID NO: 8669 - DNA, 20 bp, Artificial Sequence
  Description of Artificial Sequence: Synthetic oligonucleotide
  Target: ANGPTL3; (+) strand; PAM type: NRG; PAM sequence: CAG
aacccaggagggggaagttg

SEQ ID NO: 8670 - DNA, 20 bp, Artificial Sequence
  Description of Artificial Sequence: Synthetic oligonucleotide
  Target: ANGPTL3; (+) strand; PAM type: NRG; PAM sequence: GAG
caggagggggaagttgcagt

SEQ ID NO: 8671 - DNA, 20 bp, Artificial Sequence
  Description of Artificial Sequence: Synthetic oligonucleotide
  Target: ANGPTL3; (+) strand; PAM type: NRG; PAM sequence: GAG
gggggaagttgcagtgagct

SEQ ID NO: 8672 - DNA, 20 bp, Artificial Sequence
  Description of Artificial Sequence: Synthetic oligonucleotide
  Target: ANGPTL3; (+) strand; PAM type: NRG; PAM sequence: CAG
gagatcacgacgctgcactc

SEQ ID NO: 8673 - DNA, 20 bp, Artificial Sequence
  Description of Artificial Sequence: Synthetic oligonucleotide
  Target: ANGPTL3; (+) strand; PAM type: NRG; PAM sequence: TGG
cacgacgctgcactccagcc

SEQ ID NO: 8674 - DNA, 20 bp, Artificial Sequence
  Description of Artificial Sequence: Synthetic oligonucleotide
  Target: ANGPTL3; (+) strand; PAM type: NRG; PAM sequence: GGG
acgacgctgcactccagcct

SEQ ID NO: 8675 - DNA, 20 bp, Artificial Sequence
  Description of Artificial Sequence: Synthetic oligonucleotide
  Target: ANGPTL3; (+) strand; PAM type: NRG; PAM sequence: AAG
gcactccagcctgggcaaca

SEQ ID NO: 8676 - DNA, 20 bp, Artificial Sequence
  Description of Artificial Sequence: Synthetic oligonucleotide
  Target: ANGPTL3; (+) strand; PAM type: NRG; PAM sequence: GAG
actccagcctgggcaacaaa

SEQ ID NO: 8677 - DNA, 20 bp, Artificial Sequence
  Description of Artificial Sequence: Synthetic oligonucleotide
  Target: ANGPTL3; (+) strand; PAM type: NRG; PAM sequence: AAG
ctccgtctcaaaaataaata

SEQ ID NO: 8678 - DNA, 20 bp, Artificial Sequence
  Description of Artificial Sequence: Synthetic oligonucleotide
  Target: ANGPTL3; (+) strand; PAM type: NRG; PAM sequence: AAG
aaaaaatctttacatgtcca

SEQ ID NO: 8679 - DNA, 20 bp, Artificial Sequence
  Description of Artificial Sequence: Synthetic oligonucleotide
  Target: ANGPTL3; (+) strand; PAM type: NRG; PAM sequence: CGG
tctttacatgtccaaagata

SEQ ID NO: 8680 - DNA, 20 bp, Artificial Sequence
  Description of Artificial Sequence: Synthetic oligonucleotide
  Target: ANGPTL3; (+) strand; PAM type: NRG; PAM sequence: TAG
tataaaacttaacatgttaa

SEQ ID NO: 8681 - DNA, 20 bp, Artificial Sequence
  Description of Artificial Sequence: Synthetic oligonucleotide
  Target: ANGPTL3; (+) strand; PAM type: NRG; PAM sequence: CAG
ttaatagtgaacacacaaaa

SEQ ID NO: 8682 - DNA, 20 bp, Artificial Sequence
  Description of Artificial Sequence: Synthetic oligonucleotide
  Target: ANGPTL3; (+) strand; PAM type: NRG; PAM sequence: AAG
tagtgaacacacaaaacagt

SEQ ID NO: 8683 - DNA, 20 bp, Artificial Sequence
  Description of Artificial Sequence: Synthetic oligonucleotide
  Target: ANGPTL3; (+) strand; PAM type: NRG; PAM sequence: TAG
gaacacacaaaacagtaaga

SEQ ID NO: 8684 - DNA, 20 bp, Artificial Sequence
  Description of Artificial Sequence: Synthetic oligonucleotide
  Target: ANGPTL3; (+) strand; PAM type: NRG; PAM sequence: AAG
tagataaaattattccttca

SEQ ID NO: 8685 - DNA, 20 bp, Artificial Sequence
  Description of Artificial Sequence: Synthetic oligonucleotide
  Target: ANGPTL3; (+) strand; PAM type: NRG; PAM sequence: TGG
ttcaaagctcacttaacctc

SEQ ID NO: 8686 - DNA, 20 bp, Artificial Sequence
  Description of Artificial Sequence: Synthetic oligonucleotide
  Target: ANGPTL3; (+) strand; PAM type: NRG; PAM sequence: AAG
ctggatctacactgtccaaa

SEQ ID NO: 8687 - DNA, 20 bp, Artificial Sequence
  Description of Artificial Sequence: Synthetic oligonucleotide
  Target: ANGPTL3; (+) strand; PAM type: NRG; PAM sequence: CGG
atctacactgtccaaaaaga

SEQ ID NO: 8688 - DNA, 20 bp, Artificial Sequence
  Description of Artificial Sequence: Synthetic oligonucleotide
  Target: ANGPTL3; (+) strand; PAM type: NRG; PAM sequence: GAG
gtccaaaaagacggtctaat

SEQ ID NO: 8689 - DNA, 20 bp, Artificial Sequence
  Description of Artificial Sequence: Synthetic oligonucleotide
  Target: ANGPTL3; (+) strand; PAM type: NRG; PAM sequence: GAG
gacggtctaatgagacaatt

SEQ ID NO: 8690 - DNA, 20 bp, Artificial Sequence
  Description of Artificial Sequence: Synthetic oligonucleotide
  Target: ANGPTL3; (+) strand; PAM type: NRG; PAM sequence: TAG
tgagacaattgagcacttga

SEQ ID NO: 8691 - DNA, 20 bp, Artificial Sequence
  Description of Artificial Sequence: Synthetic oligonucleotide
  Target: ANGPTL3; (+) strand; PAM type: NRG; PAM sequence: AGG
gagacaattgagcacttgat

SEQ ID NO: 8692 - DNA, 20 bp, Artificial Sequence
  Description of Artificial Sequence: Synthetic oligonucleotide
  Target: ANGPTL3; (+) strand; PAM type: NRG; PAM sequence: GAG
caattgagcacttgataggt

SEQ ID NO: 8693 - DNA, 20 bp, Artificial Sequence
  Description of Artificial Sequence: Synthetic oligonucleotide
  Target: ANGPTL3; (+) strand; PAM type: NRG; PAM sequence: TGG
ttgagcacttgataggtgag

SEQ ID NO: 8694 - DNA, 20 bp, Artificial Sequence
  Description of Artificial Sequence: Synthetic oligonucleotide
  Target: ANGPTL3; (+) strand; PAM type: NRG; PAM sequence: GAG
ataggtgagtggttctaact

SEQ ID NO: 8695 - DNA, 20 bp, Artificial Sequence
  Description of Artificial Sequence: Synthetic oligonucleotide
  Target: ANGPTL3; (+) strand; PAM type: NRG; PAM sequence: CAG
ttctaactgagatatgttct

SEQ ID NO: 8696 - DNA, 20 bp, Artificial Sequence
  Description of Artificial Sequence: Synthetic oligonucleotide
  Target: ANGPTL3; (+) strand; PAM type: NRG; PAM sequence: TAG
tctcagtataaaacatacaa

SEQ ID NO: 8697 - DNA, 20 bp, Artificial Sequence
  Description of Artificial Sequence: Synthetic oligonucleotide
  Target: ANGPTL3; (+) strand; PAM type: NRG; PAM sequence: AGG
ctcagtataaaacatacaat

SEQ ID NO: 8698 - DNA, 20 bp, Artificial Sequence
  Description of Artificial Sequence: Synthetic oligonucleotide
  Target: ANGPTL3; (+) strand; PAM type: NRG; PAM sequence: TAG
aattaaaaaacaaactattg

SEQ ID NO: 8699 - DNA, 20 bp, Artificial Sequence
  Description of Artificial Sequence: Synthetic oligonucleotide
  Target: ANGPTL3; (+) strand; PAM type: NRG; PAM sequence: AAG
aacaaactattgtagttaaa

SEQ ID NO: 8700 - DNA, 20 bp, Artificial Sequence
  Description of Artificial Sequence: Synthetic oligonucleotide
  Target: ANGPTL3; (+) strand; PAM type: NRG; PAM sequence: AGG
acaaactattgtagttaaaa

SEQ ID NO: 8701 - DNA, 20 bp, Artificial Sequence
  Description of Artificial Sequence: Synthetic oligonucleotide
  Target: ANGPTL3; (+) strand; PAM type: NRG; PAM sequence: TAG
gtagttaaaaaggaaaaaat

SEQ ID NO: 8702 - DNA, 20 bp, Artificial Sequence
  Description of Artificial Sequence: Synthetic oligonucleotide
  Target: ANGPTL3; (+) strand; PAM type: NRG; PAM sequence: GAG
agttaaaaaggaaaaaatta

SEQ ID NO: 8703 - DNA, 20 bp, Artificial Sequence
  Description of Artificial Sequence: Synthetic oligonucleotide
  Target: ANGPTL3; (+) strand; PAM type: NRG; PAM sequence: AAG
attagagatactatgtaaaa

SEQ ID NO: 8704 - DNA, 20 bp, Artificial Sequence
  Description of Artificial Sequence: Synthetic oligonucleotide
  Target: ANGPTL3; (+) strand; PAM type: NRG; PAM sequence: GAG
tagagatactatgtaaaaaa

SEQ ID NO: 8705 - DNA, 20 bp, Artificial Sequence
  Description of Artificial Sequence: Synthetic oligonucleotide
  Target: ANGPTL3; (+) strand; PAM type: NRG; PAM sequence: AAG
ataccttgtattttatttga

SEQ ID NO: 8706 - DNA, 20 bp, Artificial Sequence
  Description of Artificial Sequence: Synthetic oligonucleotide
  Target: ANGPTL3; (+) strand; PAM type: NRG; PAM sequence: AAG
tttgaaagacatatctccat

SEQ ID NO: 8707 - DNA, 20 bp, Artificial Sequence
  Description of Artificial Sequence: Synthetic oligonucleotide
  Target: ANGPTL3; (+) strand; PAM type: NRG; PAM sequence: TAG
taagattacacaacctcgtg

SEQ ID NO: 8708 - DNA, 20 bp, Artificial Sequence
  Description of Artificial Sequence: Synthetic oligonucleotide
  Target: ANGPTL3; (+) strand; PAM type: NRG; PAM sequence: AGG
aagattacacaacctcgtgt

SEQ ID NO: 8709 - DNA, 20 bp, Artificial Sequence
  Description of Artificial Sequence: Synthetic oligonucleotide
  Target: ANGPTL3; (+) strand; PAM type: NRG; PAM sequence: AAG
acacaacctcgtgtaggata

SEQ ID NO: 8710 - DNA, 20 bp, Artificial Sequence
  Description of Artificial Sequence: Synthetic oligonucleotide
  Target: ANGPTL3; (+) strand; PAM type: NRG; PAM sequence: AGG
cacaacctcgtgtaggataa

SEQ ID NO: 8711 - DNA, 20 bp, Artificial Sequence
  Description of Artificial Sequence: Synthetic oligonucleotide
  Target: ANGPTL3; (+) strand; PAM type: NRG; PAM sequence: TGG
ataaaggactttgctttgct

SEQ ID NO: 8712 - DNA, 20 bp, Artificial Sequence
  Description of Artificial Sequence: Synthetic oligonucleotide
  Target: ANGPTL3; (+) strand; PAM type: NRG; PAM sequence: TAG
tgcttggaatttaaacaatt

SEQ ID NO: 8713 - DNA, 20 bp, Artificial Sequence
  Description of Artificial Sequence: Synthetic oligonucleotide
  Target: ANGPTL3; (+) strand; PAM type: NRG; PAM sequence: AGG
gcttggaatttaaacaattt

SEQ ID NO: 8714 - DNA, 20 bp, Artificial Sequence
  Description of Artificial Sequence: Synthetic oligonucleotide
  Target: ANGPTL3; (+) strand; PAM type: NRG; PAM sequence: TAG
aaatgtcctaaaattctctg

SEQ ID NO: 8715 - DNA, 20 bp, Artificial Sequence
  Description of Artificial Sequence: Synthetic oligonucleotide
  Target: ANGPTL3; (+) strand; PAM type: NRG; PAM sequence: AAG
tcctaaaattctctgtagct

SEQ ID NO: 8716 - DNA, 20 bp, Artificial Sequence
  Description of Artificial Sequence: Synthetic oligonucleotide
  Target: ANGPTL3; (+) strand; PAM type: NRG; PAM sequence: TGG
tagctaagaaatttttatat

SEQ ID NO: 8717 - DNA, 20 bp, Artificial Sequence
  Description of Artificial Sequence: Synthetic oligonucleotide
  Target: ANGPTL3; (+) strand; PAM type: NRG; PAM sequence: TAG
gaaatttttatattggttcc

SEQ ID NO: 8718 - DNA, 20 bp, Artificial Sequence
  Description of Artificial Sequence: Synthetic oligonucleotide
  Target: ANGPTL3; (+) strand; PAM type: NRG; PAM sequence: AGG
aaatttttatattggttcct

SEQ ID NO: 8719 - DNA, 20 bp, Artificial Sequence
  Description of Artificial Sequence: Synthetic oligonucleotide
  Target: ANGPTL3; (+) strand; PAM type: NRG; PAM sequence: TAG
ttatattggttcctaggaac

SEQ ID NO: 8720 - DNA, 20 bp, Artificial Sequence
  Description of Artificial Sequence: Synthetic oligonucleotide
  Target: ANGPTL3; (+) strand; PAM type: NRG; PAM sequence: AGG
tatattggttcctaggaact

SEQ ID NO: 8721 - DNA, 20 bp, Artificial Sequence
  Description of Artificial Sequence: Synthetic oligonucleotide
  Target: ANGPTL3; (+) strand; PAM type: NRG; PAM sequence: TAG
ggaactaggaatccttaaat

SEQ ID NO: 8722 - DNA, 20 bp, Artificial Sequence
  Description of Artificial Sequence: Synthetic oligonucleotide
  Target: ANGPTL3; (+) strand; PAM type: NRG; PAM sequence: AGG
gaactaggaatccttaaatt

SEQ ID NO: 8723 - DNA, 20 bp, Artificial Sequence
  Description of Artificial Sequence: Synthetic oligonucleotide
  Target: ANGPTL3; (+) strand; PAM type: NRG; PAM sequence: AAG
taggccctacatttgcttac

SEQ ID NO: 8724 - DNA, 20 bp, Artificial Sequence
  Description of Artificial Sequence: Synthetic oligonucleotide
  Target: ANGPTL3; (+) strand; PAM type: NRG; PAM sequence: TGG
gcttacaagtttattttcct

SEQ ID NO: 8725 - DNA, 20 bp, Artificial Sequence
  Description of Artificial Sequence: Synthetic oligonucleotide
  Target: ANGPTL3; (+) strand; PAM type: NRG; PAM sequence: TAG
ttccttggcataaaattttt

SEQ ID NO: 8726 - DNA, 20 bp, Artificial Sequence
  Description of Artificial Sequence: Synthetic oligonucleotide
  Target: ANGPTL3; (+) strand; PAM type: NRG; PAM sequence: TGG
ttttttagtttttacattac

SEQ ID NO: 8727 - DNA, 20 bp, Artificial Sequence
  Description of Artificial Sequence: Synthetic oligonucleotide
  Target: ANGPTL3; (+) strand; PAM type: NRG; PAM sequence: CAG
cattactggttatatttgat

SEQ ID NO: 8728 - DNA, 20 bp, Artificial Sequence
  Description of Artificial Sequence: Synthetic oligonucleotide
  Target: ANGPTL3; (+) strand; PAM type: NRG; PAM sequence: AGG
attactggttatatttgatc

SEQ ID NO: 8729 - DNA, 20 bp, Artificial Sequence
  Description of Artificial Sequence: Synthetic oligonucleotide
  Target: ANGPTL3; (+) strand; PAM type: NRG; PAM sequence: GGG
ttactggttatatttgatca

SEQ ID NO: 8730 - DNA, 20 bp, Artificial Sequence
  Description of Artificial Sequence: Synthetic oligonucleotide
  Target: ANGPTL3; (+) strand; PAM type: NRG; PAM sequence: TAG
tgatcagggttctatttaaa

SEQ ID NO: 8731 - DNA, 20 bp, Artificial Sequence
  Description of Artificial Sequence: Synthetic oligonucleotide
  Target: ANGPTL3; (+) strand; PAM type: NRG; PAM sequence: AGG
gatcagggttctatttaaat

SEQ ID NO: 8732 - DNA, 20 bp, Artificial Sequence
  Description of Artificial Sequence: Synthetic oligonucleotide
  Target: ANGPTL3; (+) strand; PAM type: NRG; PAM sequence: AAG
ggttctatttaaataggcac

SEQ ID NO: 8733 - DNA, 20 bp, Artificial Sequence
  Description of Artificial Sequence: Synthetic oligonucleotide
  Target: ANGPTL3; (+) strand; PAM type: NRG; PAM sequence: AAG
atttaaataggcacaagttc

SEQ ID NO: 8734 - DNA, 20 bp, Artificial Sequence
  Description of Artificial Sequence: Synthetic oligonucleotide
  Target: ANGPTL3; (+) strand; PAM type: NRG; PAM sequence: AAG
aataggcacaagttcaagca

SEQ ID NO: 8735 - DNA, 20 bp, Artificial Sequence
  Description of Artificial Sequence: Synthetic oligonucleotide
  Target: ANGPTL3; (+) strand; PAM type: NRG; PAM sequence: CAG
gcacaagttcaagcaaagat

SEQ ID NO: 8736 - DNA, 20 bp, Artificial Sequence
  Description of Artificial Sequence: Synthetic oligonucleotide
  Target: ANGPTL3; (+) strand; PAM type: NRG; PAM sequence: TAG
caaagatcagattctgcttt

SEQ ID NO: 8737 - DNA, 20 bp, Artificial Sequence
  Description of Artificial Sequence: Synthetic oligonucleotide
  Target: ANGPTL3; (+) strand; PAM type: NRG; PAM sequence: CAG
agatcagattctgcttttag

SEQ ID NO: 8738 - DNA, 20 bp, Artificial Sequence
  Description of Artificial Sequence: Synthetic oligonucleotide
  Target: ANGPTL3; (+) strand; PAM type: NRG; PAM sequence: CAG
tgcttttagcagtgtgtact

SEQ ID NO: 8739 - DNA, 20 bp, Artificial Sequence
  Description of Artificial Sequence: Synthetic oligonucleotide
  Target: ANGPTL3; (+) strand; PAM type: NRG; PAM sequence: CAG
tttagcagtgtgtactcaga

SEQ ID NO: 8740 - DNA, 20 bp, Artificial Sequence
  Description of Artificial Sequence: Synthetic oligonucleotide
  Target: ANGPTL3; (+) strand; PAM type: NRG; PAM sequence: AGG
ttagcagtgtgtactcagac

SEQ ID NO: 8741 - DNA, 20 bp, Artificial Sequence
  Description of Artificial Sequence: Synthetic oligonucleotide
  Target: ANGPTL3; (+) strand; PAM type: NRG; PAM sequence: AAG
gcagtgtgtactcagacagg

SEQ ID NO: 8742 - DNA, 20 bp, Artificial Sequence
  Description of Artificial Sequence: Synthetic oligonucleotide
  Target: ANGPTL3; (+) strand; PAM type: NRG; PAM sequence: AAG
actcagacaggaagtattaa

SEQ ID NO: 8743 - DNA, 20 bp, Artificial Sequence
  Description of Artificial Sequence: Synthetic oligonucleotide
  Target: ANGPTL3; (+) strand; PAM type: NRG; PAM sequence: AGG
ctcagacaggaagtattaaa

SEQ ID NO: 8744 - DNA, 20 bp, Artificial Sequence
  Description of Artificial Sequence: Synthetic oligonucleotide
  Target: ANGPTL3; (+) strand; PAM type: NRG; PAM sequence: CAG
agacaggaagtattaaaagg

SEQ ID NO: 8745 - DNA, 20 bp, Artificial Sequence
  Description of Artificial Sequence: Synthetic oligonucleotide
  Target: ANGPTL3; (+) strand; PAM type: NRG; PAM sequence: AGG
gacaggaagtattaaaaggc

SEQ ID NO: 8746 - DNA, 20 bp, Artificial Sequence
  Description of Artificial Sequence: Synthetic oligonucleotide
  Target: ANGPTL3; (+) strand; PAM type: NRG; PAM sequence: CAG
aggaagtattaaaaggcagg

SEQ ID NO: 8747 - DNA, 20 bp, Artificial Sequence
  Description of Artificial Sequence: Synthetic oligonucleotide
  Target: ANGPTL3; (+) strand; PAM type: NRG; PAM sequence: CAG
cccacgttgaaatgcttctg

SEQ ID NO: 8748 - DNA, 20 bp, Artificial Sequence
  Description of Artificial Sequence: Synthetic oligonucleotide
  Target: ANGPTL3; (+) strand; PAM type: NRG; PAM sequence: TAG
atgcttctgcagtttataat

SEQ ID NO: 8749 - DNA, 20 bp, Artificial Sequence
  Description of Artificial Sequence: Synthetic oligonucleotide
  Target: ANGPTL3; (+) strand; PAM type: NRG; PAM sequence: AGG
tgcttctgcagtttataatt

SEQ ID NO: 8750 - DNA, 20 bp, Artificial Sequence
  Description of Artificial Sequence: Synthetic oligonucleotide
  Target: ANGPTL3; (+) strand; PAM type: NRG; PAM sequence: AAG
aatgctgttcaaattactat

SEQ ID NO: 8751 - DNA, 20 bp, Artificial Sequence
  Description of Artificial Sequence: Synthetic oligonucleotide
  Target: ANGPTL3; (+) strand; PAM type: NRG; PAM sequence: CAG
aaattactataagaattata

SEQ ID NO: 8752 - DNA, 20 bp, Artificial Sequence
  Description of Artificial Sequence: Synthetic oligonucleotide
  Target: ANGPTL3; (+) strand; PAM type: NRG; PAM sequence: AAG
attatacagatatttatacc

SEQ ID NO: 8753 - DNA, 20 bp, Artificial Sequence
  Description of Artificial Sequence: Synthetic oligonucleotide
  Target: ANGPTL3; (+) strand; PAM type: NRG; PAM sequence: GAG
tatacagatatttataccaa

SEQ ID NO: 8754 - DNA, 20 bp, Artificial Sequence
  Description of Artificial Sequence: Synthetic oligonucleotide
  Target: ANGPTL3; (+) strand; PAM type: NRG; PAM sequence: TAG
tataccaagagacaatatac

SEQ ID NO: 8755 - DNA, 20 bp, Artificial Sequence
  Description of Artificial Sequence: Synthetic oligonucleotide
  Target: ANGPTL3; (+) strand; PAM type: NRG; PAM sequence: AAG
gagacaatatactagaaacc

SEQ ID NO: 8756 - DNA, 20 bp, Artificial Sequence
  Description of Artificial Sequence: Synthetic oligonucleotide
  Target: ANGPTL3; (+) strand; PAM type: NRG; PAM sequence: CAG
gaccattacctctactctgt

SEQ ID NO: 8757 - DNA, 20 bp, Artificial Sequence
  Description of Artificial Sequence: Synthetic oligonucleotide
  Target: ANGPTL3; (+) strand; PAM type: NRG; PAM sequence: GAG
actctgtcagtgttatttgt

SEQ ID NO: 8758 - DNA, 20 bp, Artificial Sequence
  Description of Artificial Sequence: Synthetic oligonucleotide
  Target: ANGPTL3; (+) strand; PAM type: NRG; PAM sequence: AAG
aattgcacaaattttgcaaa

SEQ ID NO: 8759 - DNA, 20 bp, Artificial Sequence
  Description of Artificial Sequence: Synthetic oligonucleotide
  Target: ANGPTL3; (+) strand; PAM type: NRG; PAM sequence: TAG
acaaattttgcaaaaagtgt

SEQ ID NO: 8760 - DNA, 20 bp, Artificial Sequence
  Description of Artificial Sequence: Synthetic oligonucleotide
  Target: ANGPTL3; (+) strand; PAM type: NRG; PAM sequence: CAG
aaagtgttagtatcctacta

SEQ ID NO: 8761 - DNA, 20 bp, Artificial Sequence
  Description of Artificial Sequence: Synthetic oligonucleotide
  Target: ANGPTL3; (+) strand; PAM type: NRG; PAM sequence: TAG
gtgttagtatcctactacag

SEQ ID NO: 8762 - DNA, 20 bp, Artificial Sequence
  Description of Artificial Sequence: Synthetic oligonucleotide
  Target: ANGPTL3; (+) strand; PAM type: NRG; PAM sequence: AGG
tgttagtatcctactacagt

SEQ ID NO: 8763 - DNA, 20 bp, Artificial Sequence
  Description of Artificial Sequence: Synthetic oligonucleotide
  Target: ANGPTL3; (+) strand; PAM type: NRG; PAM sequence: TAG
tactacagtaggatataata

SEQ ID NO: 8764 - DNA, 20 bp, Artificial Sequence
  Description of Artificial Sequence: Synthetic oligonucleotide
  Target: ANGPTL3; (+) strand; PAM type: NRG; PAM sequence: AAG
tacagtaggatataatatag

SEQ ID NO: 8765 - DNA, 20 bp, Artificial Sequence
  Description of Artificial Sequence: Synthetic oligonucleotide
  Target: ANGPTL3; (+) strand; PAM type: NRG; PAM sequence: AGG
acagtaggatataatataga

SEQ ID NO: 8766 - DNA, 20 bp, Artificial Sequence
  Description of Artificial Sequence: Synthetic oligonucleotide
  Target: ANGPTL3; (+) strand; PAM type: NRG; PAM sequence: AAG
tagaaggaaataatttcata

SEQ ID NO: 8767 - DNA, 20 bp, Artificial Sequence
  Description of Artificial Sequence: Synthetic oligonucleotide
  Target: ANGPTL3; (+) strand; PAM type: NRG; PAM sequence: TGG
aatttcataaagcctgtctt

SEQ ID NO: 8768 - DNA, 20 bp, Artificial Sequence
  Description of Artificial Sequence: Synthetic oligonucleotide
  Target: ANGPTL3; (+) strand; PAM type: NRG; PAM sequence: TAG
ataaagcctgtctttggtac

SEQ ID NO: 8769 - DNA, 20 bp, Artificial Sequence
  Description of Artificial Sequence: Synthetic oligonucleotide
  Target: ANGPTL3; (+) strand; PAM type: NRG; PAM sequence: CAG
ctgtctttggtactagtgct

SEQ ID NO: 8770 - DNA, 20 bp, Artificial Sequence
  Description of Artificial Sequence: Synthetic oligonucleotide
  Target: ANGPTL3; (+) strand; PAM type: NRG; PAM sequence: AAG
gttactttcattaactaaaa

SEQ ID NO: 8771 - DNA, 20 bp, Artificial Sequence
  Description of Artificial Sequence: Synthetic oligonucleotide
  Target: ANGPTL3; (+) strand; PAM type: NRG; PAM sequence: AGG
ttactttcattaactaaaaa

SEQ ID NO: 8772 - DNA, 20 bp, Artificial Sequence
  Description of Artificial Sequence: Synthetic oligonucleotide
  Target: ANGPTL3; (+) strand; PAM type: NRG; PAM sequence: GGG
tactttcattaactaaaaaa

SEQ ID NO: 8773 - DNA, 20 bp, Artificial Sequence
  Description of Artificial Sequence: Synthetic oligonucleotide
  Target: ANGPTL3; (+) strand; PAM type: NRG; PAM sequence: GGG
actttcattaactaaaaaag

SEQ ID NO: 8774 - DNA, 20 bp, Artificial Sequence
  Description of Artificial Sequence: Synthetic oligonucleotide
  Target: ANGPTL3; (+) strand; PAM type: NRG; PAM sequence: AAG
ttcaaattcccttctctaaa

SEQ ID NO: 8775 - DNA, 20 bp, Artificial Sequence
  Description of Artificial Sequence: Synthetic oligonucleotide
  Target: ANGPTL3; (+) strand; PAM type: NRG; PAM sequence: AAG
aaaagaatgtactatatcaa

SEQ ID NO: 8776 - DNA, 20 bp, Artificial Sequence
  Description of Artificial Sequence: Synthetic oligonucleotide
  Target: ANGPTL3; (+) strand; PAM type: NRG; PAM sequence: AGG
aaagaatgtactatatcaaa

SEQ ID NO: 8777 - DNA, 20 bp, Artificial Sequence
  Description of Artificial Sequence: Synthetic oligonucleotide
  Target: ANGPTL3; (+) strand; PAM type: NRG; PAM sequence: GGG
aagaatgtactatatcaaaa

SEQ ID NO: 8778 - DNA, 20 bp, Artificial Sequence
  Description of Artificial Sequence: Synthetic oligonucleotide
  Target: ANGPTL3; (+) strand; PAM type: NRG; PAM sequence: GGG
agaatgtactatatcaaaag

SEQ ID NO: 8779 - DNA, 20 bp, Artificial Sequence
  Description of Artificial Sequence: Synthetic oligonucleotide
  Target: ANGPTL3; (+) strand; PAM type: NRG; PAM sequence: GGG
gaatgtactatatcaaaagg

SEQ ID NO: 8780 - DNA, 20 bp, Artificial Sequence
  Description of Artificial Sequence: Synthetic oligonucleotide
  Target: ANGPTL3; (+) strand; PAM type: NRG; PAM sequence: TAG
ctacgtatacattctgcact

SEQ ID NO: 8781 - DNA, 20 bp, Artificial Sequence
  Description of Artificial Sequence: Synthetic oligonucleotide
  Target: ANGPTL3; (+) strand; PAM type: NRG; PAM sequence: AAG
atattgtttctacaatgtgt

SEQ ID NO: 8782 - DNA, 20 bp, Artificial Sequence
  Description of Artificial Sequence: Synthetic oligonucleotide
  Target: ANGPTL3; (+) strand; PAM type: NRG; PAM sequence: AGG
tattgtttctacaatgtgta

SEQ ID NO: 8783 - DNA, 20 bp, Artificial Sequence
  Description of Artificial Sequence: Synthetic oligonucleotide
  Target: ANGPTL3; (+) strand; PAM type: NRG; PAM sequence: AAG
tgtaaggcattactgtacta

SEQ ID NO: 8784 - DNA, 20 bp, Artificial Sequence
  Description of Artificial Sequence: Synthetic oligonucleotide
  Target: ANGPTL3; (+) strand; PAM type: NRG; PAM sequence: AAG
ttactgtactaaagcattat

SEQ ID NO: 8785 - DNA, 20 bp, Artificial Sequence
  Description of Artificial Sequence: Synthetic oligonucleotide
  Target: ANGPTL3; (+) strand; PAM type: NRG; PAM sequence: AGG
tactgtactaaagcattata

SEQ ID NO: 8786 - DNA, 20 bp, Artificial Sequence
  Description of Artificial Sequence: Synthetic oligonucleotide
  Target: ANGPTL3; (+) strand; PAM type: NRG; PAM sequence: AAG
taaagcattataaggaatat

SEQ ID NO: 8787 - DNA, 20 bp, Artificial Sequence
  Description of Artificial Sequence: Synthetic oligonucleotide
  Target: ANGPTL3; (+) strand; PAM type: NRG; PAM sequence: CAG
atacaaatcttgccaatcaa

SEQ ID NO: 8788 - DNA, 20 bp, Artificial Sequence
  Description of Artificial Sequence: Synthetic oligonucleotide
  Target: ANGPTL3; (+) strand; PAM type: NRG; PAM sequence: TAG
tcttgccaatcaacagctta

SEQ ID NO: 8789 - DNA, 20 bp, Artificial Sequence
  Description of Artificial Sequence: Synthetic oligonucleotide
  Target: ANGPTL3; (+) strand; PAM type: NRG; PAM sequence: TAG
atcaacagcttatagtgtaa

SEQ ID NO: 8790 - DNA, 20 bp, Artificial Sequence
  Description of Artificial Sequence: Synthetic oligonucleotide
  Target: ANGPTL3; (+) strand; PAM type: NRG; PAM sequence: AGG
tcaacagcttatagtgtaat

SEQ ID NO: 8791 - DNA, 20 bp, Artificial Sequence
  Description of Artificial Sequence: Synthetic oligonucleotide
  Target: ANGPTL3; (+) strand; PAM type: NRG; PAM sequence: GGG
caacagcttatagtgtaata

SEQ ID NO: 8792 - DNA, 20 bp, Artificial Sequence
  Description of Artificial Sequence: Synthetic oligonucleotide
  Target: ANGPTL3; (+) strand; PAM type: NRG; PAM sequence: GGG
aacagcttatagtgtaatag

SEQ ID NO: 8793 - DNA, 20 bp, Artificial Sequence
  Description of Artificial Sequence: Synthetic oligonucleotide
  Target: ANGPTL3; (+) strand; PAM type: NRG; PAM sequence: GAG
cagcttatagtgtaataggg

SEQ ID NO: 8794 - DNA, 20 bp, Artificial Sequence
  Description of Artificial Sequence: Synthetic oligonucleotide
  Target: ANGPTL3; (+) strand; PAM type: NRG; PAM sequence: GAG
gcttatagtgtaatagggga

SEQ ID NO: 8795 - DNA, 20 bp, Artificial Sequence
  Description of Artificial Sequence: Synthetic oligonucleotide
  Target: ANGPTL3; (+) strand; PAM type: NRG; PAM sequence: AAG
tatagtgtaataggggagag

SEQ ID NO: 8796 - DNA, 20 bp, Artificial Sequence
  Description of Artificial Sequence: Synthetic oligonucleotide
  Target: ANGPTL3; (+) strand; PAM type: NRG; PAM sequence: TGG
gtgtaataggggagagaagc

SEQ ID NO: 8797 - DNA, 20 bp, Artificial Sequence
  Description of Artificial Sequence: Synthetic oligonucleotide
  Target: ANGPTL3; (+) strand; PAM type: NRG; PAM sequence: TAG
catctatattctccctcaac

SEQ ID NO: 8798 - DNA, 20 bp, Artificial Sequence
  Description of Artificial Sequence: Synthetic oligonucleotide
  Target: ANGPTL3; (+) strand; PAM type: NRG; PAM sequence: AAG
tatattctccctcaactagc

SEQ ID NO: 8799 - DNA, 20 bp, Artificial Sequence
  Description of Artificial Sequence: Synthetic oligonucleotide
  Target: ANGPTL3; (+) strand; PAM type: NRG; PAM sequence: TGG
attctccctcaactagcaag

SEQ ID NO: 8800 - DNA, 20 bp, Artificial Sequence
  Description of Artificial Sequence: Synthetic oligonucleotide
  Target: ANGPTL3; (+) strand; PAM type: NRG; PAM sequence: CAG
ctagcaagtggatgaaatat

SEQ ID NO: 8801 - DNA, 20 bp, Artificial Sequence
  Description of Artificial Sequence: Synthetic oligonucleotide
  Target: ANGPTL3; (+) strand; PAM type: NRG; PAM sequence: AGG
tagcaagtggatgaaatatc

SEQ ID NO: 8802 - DNA, 20 bp, Artificial Sequence
  Description of Artificial Sequence: Synthetic oligonucleotide
  Target: ANGPTL3; (+) strand; PAM type: NRG; PAM sequence: GGG
agcaagtggatgaaatatca

SEQ ID NO: 8803 - DNA, 20 bp, Artificial Sequence
  Description of Artificial Sequence: Synthetic oligonucleotide
  Target: ANGPTL3; (+) strand; PAM type: NRG; PAM sequence: TAG
ggatgaaatatcagggtcaa

SEQ ID NO: 8804 - DNA, 20 bp, Artificial Sequence
  Description of Artificial Sequence: Synthetic oligonucleotide
  Target: ANGPTL3; (+) strand; PAM type: NRG; PAM sequence: AAG
atatcagggtcaatagttat

SEQ ID NO: 8805 - DNA, 20 bp, Artificial Sequence
  Description of Artificial Sequence: Synthetic oligonucleotide
  Target: ANGPTL3; (+) strand; PAM type: NRG; PAM sequence: AAG
tcaatagttataagccacaa

SEQ ID NO: 8806 - DNA, 20 bp, Artificial Sequence
  Description of Artificial Sequence: Synthetic oligonucleotide
  Target: ANGPTL3; (+) strand; PAM type: NRG; PAM sequence: CAG
ttataagccacaaaagctga

SEQ ID NO: 8807 - DNA, 20 bp, Artificial Sequence
  Description of Artificial Sequence: Synthetic oligonucleotide
  Target: ANGPTL3; (+) strand; PAM type: NRG; PAM sequence: AAG
caaaagctgacagcttaatt

SEQ ID NO: 8808 - DNA, 20 bp, Artificial Sequence
  Description of Artificial Sequence: Synthetic oligonucleotide
  Target: ANGPTL3; (+) strand; PAM type: NRG; PAM sequence: GAG
aaagctgacagcttaattaa

SEQ ID NO: 8809 - DNA, 20 bp, Artificial Sequence
  Description of Artificial Sequence: Synthetic oligonucleotide
  Target: ANGPTL3; (+) strand; PAM type: NRG; PAM sequence: AAG
gctgacagcttaattaagag

SEQ ID NO: 8810 - DNA, 20 bp, Artificial Sequence
  Description of Artificial Sequence: Synthetic oligonucleotide
  Target: ANGPTL3; (+) strand; PAM type: NRG; PAM sequence: AAG
aactgtaacttttctattta

SEQ ID NO: 8811 - DNA, 20 bp, Artificial Sequence
  Description of Artificial Sequence: Synthetic oligonucleotide
  Target: ANGPTL3; (+) strand; PAM type: NRG; PAM sequence: AAG
tgtaacttttctatttaaag

SEQ ID NO: 8812 - DNA, 20 bp, Artificial Sequence
  Description of Artificial Sequence: Synthetic oligonucleotide
  Target: ANGPTL3; (+) strand; PAM type: NRG; PAM sequence: AGG
gtaacttttctatttaaaga

SEQ ID NO: 8813 - DNA, 20 bp, Artificial Sequence
  Description of Artificial Sequence: Synthetic oligonucleotide
  Target: ANGPTL3; (+) strand; PAM type: NRG; PAM sequence: GAG
aacttttctatttaaagaag

SEQ ID NO: 8814 - DNA, 20 bp, Artificial Sequence
  Description of Artificial Sequence: Synthetic oligonucleotide
  Target: ANGPTL3; (+) strand; PAM type: NRG; PAM sequence: TAG
gaaaatttgaatttcttctc

SEQ ID NO: 8815 - DNA, 20 bp, Artificial Sequence
  Description of Artificial Sequence: Synthetic oligonucleotide
  Target: ANGPTL3; (+) strand; PAM type: NRG; PAM sequence: CAG
tataattccattacatgaac

SEQ ID NO: 8816 - DNA, 20 bp, Artificial Sequence
  Description of Artificial Sequence: Synthetic oligonucleotide
  Target: ANGPTL3; (+) strand; PAM type: NRG; PAM sequence: GAG
taattccattacatgaacca

SEQ ID NO: 8817 - DNA, 20 bp, Artificial Sequence
  Description of Artificial Sequence: Synthetic oligonucleotide
  Target: ANGPTL3; (+) strand; PAM type: NRG; PAM sequence: AAG
ccattacatgaaccagagta

SEQ ID NO: 8818 - DNA, 20 bp, Artificial Sequence
  Description of Artificial Sequence: Synthetic oligonucleotide
  Target: ANGPTL3; (+) strand; PAM type: NRG; PAM sequence: AGG
cattacatgaaccagagtaa

SEQ ID NO: 8819 - DNA, 20 bp, Artificial Sequence
  Description of Artificial Sequence: Synthetic oligonucleotide
  Target: ANGPTL3; (+) strand; PAM type: NRG; PAM sequence: GGG
attacatgaaccagagtaaa

SEQ ID NO: 8820 - DNA, 20 bp, Artificial Sequence
  Description of Artificial Sequence: Synthetic oligonucleotide
  Target: ANGPTL3; (+) strand; PAM type: NRG; PAM sequence: AAG
catgaaccagagtaaagggt

SEQ ID NO: 8821 - DNA, 20 bp, Artificial Sequence
  Description of Artificial Sequence: Synthetic oligonucleotide
  Target: ANGPTL3; (+) strand; PAM type: NRG; PAM sequence: TGG
aaccagagtaaagggtaaga

SEQ ID NO: 8822 - DNA, 20 bp, Artificial Sequence
  Description of Artificial Sequence: Synthetic oligonucleotide
  Target: ANGPTL3; (+) strand; PAM type: NRG; PAM sequence: AAG
taaagggtaagatggaaatg

SEQ ID NO: 8823 - DNA, 20 bp, Artificial Sequence
  Description of Artificial Sequence: Synthetic oligonucleotide
  Target: ANGPTL3; (+) strand; PAM type: NRG; PAM sequence: TGG
aatattttcttacccttttg

SEQ ID NO: 8824 - DNA, 20 bp, Artificial Sequence
  Description of Artificial Sequence: Synthetic oligonucleotide
  Target: ANGPTL3; (+) strand; PAM type: NRG; PAM sequence: TGG
acccttttgtggttctatat

SEQ ID NO: 8825 - DNA, 20 bp, Artificial Sequence
  Description of Artificial Sequence: Synthetic oligonucleotide
  Target: ANGPTL3; (+) strand; PAM type: NRG; PAM sequence: AAG
atcatacacaacctaatcaa

SEQ ID NO: 8826 - DNA, 20 bp, Artificial Sequence
  Description of Artificial Sequence: Synthetic oligonucleotide
  Target: ANGPTL3; (+) strand; PAM type: NRG; PAM sequence: AAG
aaaagatgtaattctttaaa

SEQ ID NO: 8827 - DNA, 20 bp, Artificial Sequence
  Description of Artificial Sequence: Synthetic oligonucleotide
  Target: ANGPTL3; (+) strand; PAM type: NRG; PAM sequence: AGG
aaagatgtaattctttaaaa

SEQ ID NO: 8828 - DNA, 20 bp, Artificial Sequence
  Description of Artificial Sequence: Synthetic oligonucleotide
  Target: ANGPTL3; (+) strand; PAM type: NRG; PAM sequence: GAG
gtaattctttaaaaaggtac

SEQ ID NO: 8829 - DNA, 20 bp, Artificial Sequence
  Description of Artificial Sequence: Synthetic oligonucleotide
  Target: ANGPTL3; (+) strand; PAM type: NRG; PAM sequence: CAG
aaaggtacgagaccaaaatt

SEQ ID NO: 8830 - DNA, 20 bp, Artificial Sequence
  Description of Artificial Sequence: Synthetic oligonucleotide
  Target: ANGPTL3; (+) strand; PAM type: NRG; PAM sequence: TAG
agaccaaaattcagaaaatc

SEQ ID NO: 8831 - DNA, 20 bp, Artificial Sequence
  Description of Artificial Sequence: Synthetic oligonucleotide
  Target: ANGPTL3; (+) strand; PAM type: NRG; PAM sequence: CAG
aatatgcaattaattttcac

SEQ ID NO: 8832 - DNA, 20 bp, Artificial Sequence
  Description of Artificial Sequence: Synthetic oligonucleotide
  Target: ANGPTL3; (+) strand; PAM type: NRG; PAM sequence: TAG
ttttcaccagtaaaatacta

SEQ ID NO: 8833 - DNA, 20 bp, Artificial Sequence
  Description of Artificial Sequence: Synthetic oligonucleotide
  Target: ANGPTL3; (+) strand; PAM type: NRG; PAM sequence: TGG
accagtaaaatactatagta

SEQ ID NO: 8834 - DNA, 20 bp, Artificial Sequence
  Description of Artificial Sequence: Synthetic oligonucleotide
  Target: ANGPTL3; (+) strand; PAM type: NRG; PAM sequence: GGG
ccagtaaaatactatagtat

SEQ ID NO: 8835 - DNA, 20 bp, Artificial Sequence
  Description of Artificial Sequence: Synthetic oligonucleotide
  Target: ANGPTL3; (+) strand; PAM type: NRG; PAM sequence: TAG
atgggtacaaatgcattgat

SEQ ID NO: 8836 - DNA, 20 bp, Artificial Sequence
  Description of Artificial Sequence: Synthetic oligonucleotide
  Target: ANGPTL3; (+) strand; PAM type: NRG; PAM sequence: TGG
attagttctaattacaaaaa

SEQ ID NO: 8837 - DNA, 20 bp, Artificial Sequence
  Description of Artificial Sequence: Synthetic oligonucleotide
  Target: ANGPTL3; (+) strand; PAM type: NRG; PAM sequence: TAG
ggctaatatataatactgtg

SEQ ID NO: 8838 - DNA, 20 bp, Artificial Sequence
  Description of Artificial Sequence: Synthetic oligonucleotide
  Target: ANGPTL3; (+) strand; PAM type: NRG; PAM sequence: CAG
gtgtagtgtttatgatacat

SEQ ID NO: 8839 - DNA, 20 bp, Artificial Sequence
  Description of Artificial Sequence: Synthetic oligonucleotide
  Target: ANGPTL3; (+) strand; PAM type: NRG; PAM sequence: AAG
gatacatcagataatgttct

SEQ ID NO: 8840 - DNA, 20 bp, Artificial Sequence
  Description of Artificial Sequence: Synthetic oligonucleotide
  Target: ANGPTL3; (+) strand; PAM type: NRG; PAM sequence: TAG
ttttatacgaccctataaaa

SEQ ID NO: 8841 - DNA, 20 bp, Artificial Sequence
  Description of Artificial Sequence: Synthetic oligonucleotide
  Target: ANGPTL3; (+) strand; PAM type: NRG; PAM sequence: AGG
tttatacgaccctataaaat

SEQ ID NO: 8842 - DNA, 20 bp, Artificial Sequence
  Description of Artificial Sequence: Synthetic oligonucleotide
  Target: ANGPTL3; (+) strand; PAM type: NRG; PAM sequence: TGG
aaaataggtgttattctcac

SEQ ID NO: 8843 - DNA, 20 bp, Artificial Sequence
  Description of Artificial Sequence: Synthetic oligonucleotide
  Target: ANGPTL3; (+) strand; PAM type: NRG; PAM sequence: GAG
aataggtgttattctcactg

SEQ ID NO: 8844 - DNA, 20 bp, Artificial Sequence
  Description of Artificial Sequence: Synthetic oligonucleotide
  Target: ANGPTL3; (+) strand; PAM type: NRG; PAM sequence: GAG
taggtgttattctcactgga

SEQ ID NO: 8845 - DNA, 20 bp, Artificial Sequence
  Description of Artificial Sequence: Synthetic oligonucleotide
  Target: ANGPTL3; (+) strand; PAM type: NRG; PAM sequence: GAG
gttattctcactggagagat

SEQ ID NO: 8846 - DNA, 20 bp, Artificial Sequence
  Description of Artificial Sequence: Synthetic oligonucleotide
  Target: ANGPTL3; (+) strand; PAM type: NRG; PAM sequence: CAG
tcactggagagatgagaaaa

SEQ ID NO: 8847 - DNA, 20 bp, Artificial Sequence
  Description of Artificial Sequence: Synthetic oligonucleotide
  Target: ANGPTL3; (+) strand; PAM type: NRG; PAM sequence: AGG
cactggagagatgagaaaac

SEQ ID NO: 8848 - DNA, 20 bp, Artificial Sequence
  Description of Artificial Sequence: Synthetic oligonucleotide
  Target: ANGPTL3; (+) strand; PAM type: NRG; PAM sequence: GGG
actggagagatgagaaaaca

SEQ ID NO: 8849 - DNA, 20 bp, Artificial Sequence
  Description of Artificial Sequence: Synthetic oligonucleotide
  Target: ANGPTL3; (+) strand; PAM type: NRG; PAM sequence: GGG
ctggagagatgagaaaacag

SEQ ID NO: 8850 - DNA, 20 bp, Artificial Sequence
  Description of Artificial Sequence: Synthetic oligonucleotide
  Target: ANGPTL3; (+) strand; PAM type: NRG; PAM sequence: CAG
gagatgagaaaacaggggtt

SEQ ID NO: 8851 - DNA, 20 bp, Artificial Sequence
  Description of Artificial Sequence: Synthetic oligonucleotide
  Target: ANGPTL3; (+) strand; PAM type: NRG; PAM sequence: GAG
gatgagaaaacaggggttca

SEQ ID NO: 8852 - DNA, 20 bp, Artificial Sequence
  Description of Artificial Sequence: Synthetic oligonucleotide
  Target: ANGPTL3; (+) strand; PAM type: NRG; PAM sequence: AAG
aacaggggttcagagatgtg

SEQ ID NO: 8853 - DNA, 20 bp, Artificial Sequence
  Description of Artificial Sequence: Synthetic oligonucleotide
  Target: ANGPTL3; (+) strand; PAM type: NRG; PAM sequence: AAG
gatgtgaagtaatttgacca

SEQ ID NO: 8854 - DNA, 20 bp, Artificial Sequence
  Description of Artificial Sequence: Synthetic oligonucleotide
  Target: ANGPTL3; (+) strand; PAM type: NRG; PAM sequence: AGG
atgtgaagtaatttgaccaa

SEQ ID NO: 8855 - DNA, 20 bp, Artificial Sequence
  Description of Artificial Sequence: Synthetic oligonucleotide
  Target: ANGPTL3; (+) strand; PAM type: NRG; PAM sequence: AAG
taatttgaccaaaggtcaca

SEQ ID NO: 8856 - DNA, 20 bp, Artificial Sequence
  Description of Artificial Sequence: Synthetic oligonucleotide
  Target: ANGPTL3; (+) strand; PAM type: NRG; PAM sequence: AAG
gaccaaaggtcacaaagctg

SEQ ID NO: 8857 - DNA, 20 bp, Artificial Sequence
  Description of Artificial Sequence: Synthetic oligonucleotide
  Target: ANGPTL3; (+) strand; PAM type: NRG; PAM sequence: CGG
aagctgaagaatatgaaatc

SEQ ID NO: 8858 - DNA, 20 bp, Artificial Sequence
  Description of Artificial Sequence: Synthetic oligonucleotide
  Target: ANGPTL3; (+) strand; PAM type: NRG; PAM sequence: GGG
agctgaagaatatgaaatcc

SEQ ID NO: 8859 - DNA, 20 bp, Artificial Sequence
  Description of Artificial Sequence: Synthetic oligonucleotide
  Target: ANGPTL3; (+) strand; PAM type: NRG; PAM sequence: CAG
tgaaatccgggattctgatt

SEQ ID NO: 8860 - DNA, 20 bp, Artificial Sequence
  Description of Artificial Sequence: Synthetic oligonucleotide
  Target: ANGPTL3; (+) strand; PAM type: NRG; PAM sequence: AGG
gaaatccgggattctgattc

SEQ ID NO: 8861 - DNA, 20 bp, Artificial Sequence
  Description of Artificial Sequence: Synthetic oligonucleotide
  Target: ANGPTL3; (+) strand; PAM type: NRG; PAM sequence: CAG
atccgggattctgattcagg

SEQ ID NO: 8862 - DNA, 20 bp, Artificial Sequence
  Description of Artificial Sequence: Synthetic oligonucleotide
  Target: ANGPTL3; (+) strand; PAM type: NRG; PAM sequence: CAG
tgattcaggcagtcttattc

SEQ ID NO: 8863 - DNA, 20 bp, Artificial Sequence
  Description of Artificial Sequence: Synthetic oligonucleotide
  Target: ANGPTL3; (+) strand; PAM type: NRG; PAM sequence: TGG
aatcatgctcttaaccacta

SEQ ID NO: 8864 - DNA, 20 bp, Artificial Sequence
  Description of Artificial Sequence: Synthetic oligonucleotide
  Target: ANGPTL3; (+) strand; PAM type: NRG; PAM sequence: AAG
tacccaaaacccttaatcct

SEQ ID NO: 8865 - DNA, 20 bp, Artificial Sequence
  Description of Artificial Sequence: Synthetic oligonucleotide
  Target: ANGPTL3; (+) strand; PAM type: NRG; PAM sequence: AAG
ccttaatcctaagtcatcaa

SEQ ID NO: 8866 - DNA, 20 bp, Artificial Sequence
  Description of Artificial Sequence: Synthetic oligonucleotide
  Target: ANGPTL3; (+) strand; PAM type: NRG; PAM sequence: AGG
cttaatcctaagtcatcaaa

SEQ ID NO: 8867 - DNA, 20 bp, Artificial Sequence
  Description of Artificial Sequence: Synthetic oligonucleotide
  Target: ANGPTL3; (+) strand; PAM type: NRG; PAM sequence: AAG
aatcctaagtcatcaaaagg

SEQ ID NO: 8868 - DNA, 20 bp, Artificial Sequence
  Description of Artificial Sequence: Synthetic oligonucleotide
  Target: ANGPTL3; (+) strand; PAM type: NRG; PAM sequence: GAG
tcctaagtcatcaaaaggaa

SEQ ID NO: 8869 - DNA, 20 bp, Artificial Sequence
  Description of Artificial Sequence: Synthetic oligonucleotide
  Target: ANGPTL3; (+) strand; PAM type: NRG; PAM sequence: AAG
agcctctattttacacaatg

SEQ ID NO: 8870 - DNA, 20 bp, Artificial Sequence
  Description of Artificial Sequence: Synthetic oligonucleotide
  Target: ANGPTL3; (+) strand; PAM type: NRG; PAM sequence: GAG
cctctattttacacaatgaa

SEQ ID NO: 8871 - DNA, 20 bp, Artificial Sequence
  Description of Artificial Sequence: Synthetic oligonucleotide
  Target: ANGPTL3; (+) strand; PAM type: NRG; PAM sequence: AGG
ctctattttacacaatgaag

SEQ ID NO: 8872 - DNA, 20 bp, Artificial Sequence
  Description of Artificial Sequence: Synthetic oligonucleotide
  Target: ANGPTL3; (+) strand; PAM type: NRG; PAM sequence: AAG
cacaatgaagaggcatttct

SEQ ID NO: 8873 - DNA, 20 bp, Artificial Sequence
  Description of Artificial Sequence: Synthetic oligonucleotide
  Target: ANGPTL3; (+) strand; PAM type: NRG; PAM sequence: TAG
tgaagaggcatttctaagaa

SEQ ID NO: 8874 - DNA, 20 bp, Artificial Sequence
  Description of Artificial Sequence: Synthetic oligonucleotide
  Target: ANGPTL3; (+) strand; PAM type: NRG; PAM sequence: TAG
catttctaagaatagaaatt

SEQ ID NO: 8875 - DNA, 20 bp, Artificial Sequence
  Description of Artificial Sequence: Synthetic oligonucleotide
  Target: ANGPTL3; (+) strand; PAM type: NRG; PAM sequence: AGG
atttctaagaatagaaattt

SEQ ID NO: 8876 - DNA, 20 bp, Artificial Sequence
  Description of Artificial Sequence: Synthetic oligonucleotide
  Target: ANGPTL3; (+) strand; PAM type: NRG; PAM sequence: GGG
tttctaagaatagaaattta

SEQ ID NO: 8877 - DNA, 20 bp, Artificial Sequence
  Description of Artificial Sequence: Synthetic oligonucleotide
  Target: ANGPTL3; (+) strand; PAM type: NRG; PAM sequence: GAG
aagaatagaaatttagggac

SEQ ID NO: 8878 - DNA, 20 bp, Artificial Sequence
  Description of Artificial Sequence: Synthetic oligonucleotide
  Target: ANGPTL3; (+) strand; PAM type: NRG; PAM sequence: CAG
tagaaatttagggacgagca

SEQ ID NO: 8879 - DNA, 20 bp, Artificial Sequence
  Description of Artificial Sequence: Synthetic oligonucleotide
  Target: ANGPTL3; (+) strand; PAM type: NRG; PAM sequence: TGG
aaatttagggacgagcacag

SEQ ID NO: 8880 - DNA, 20 bp, Artificial Sequence
  Description of Artificial Sequence: Synthetic oligonucleotide
  Target: ANGPTL3; (+) strand; PAM type: NRG; PAM sequence: CAG
gtggcttactcctttaatat

SEQ ID NO: 8881 - DNA, 20 bp, Artificial Sequence
  Description of Artificial Sequence: Synthetic oligonucleotide
  Target: ANGPTL3; (+) strand; PAM type: NRG; PAM sequence: GAG
tcctttaatatcagcacttt

SEQ ID NO: 8882 - DNA, 20 bp, Artificial Sequence
  Description of Artificial Sequence: Synthetic oligonucleotide
  Target: ANGPTL3; (+) strand; PAM type: NRG; PAM sequence: GAG
ctttaatatcagcactttga

SEQ ID NO: 8883 - DNA, 20 bp, Artificial Sequence
  Description of Artificial Sequence: Synthetic oligonucleotide
  Target: ANGPTL3; (+) strand; PAM type: NRG; PAM sequence: AGG
tttaatatcagcactttgag

SEQ ID NO: 8884 - DNA, 20 bp, Artificial Sequence
  Description of Artificial Sequence: Synthetic oligonucleotide
  Target: ANGPTL3; (+) strand; PAM type: NRG; PAM sequence: TGG
agcactttgagaggctgata

SEQ ID NO: 8885 - DNA, 20 bp, Artificial Sequence
  Description of Artificial Sequence: Synthetic oligonucleotide
  Target: ANGPTL3; (+) strand; PAM type: NRG; PAM sequence: GGG
gcactttgagaggctgatat

SEQ ID NO: 8886 - DNA, 20 bp, Artificial Sequence
  Description of Artificial Sequence: Synthetic oligonucleotide
  Target: ANGPTL3; (+) strand; PAM type: NRG; PAM sequence: GAG
actttgagaggctgatatgg

SEQ ID NO: 8887 - DNA, 20 bp, Artificial Sequence
  Description of Artificial Sequence: Synthetic oligonucleotide
  Target: ANGPTL3; (+) strand; PAM type: NRG; PAM sequence: AGG
ctttgagaggctgatatggg

SEQ ID NO: 8888 - DNA, 20 bp, Artificial Sequence
  Description of Artificial Sequence: Synthetic oligonucleotide
  Target: ANGPTL3; (+) strand; PAM type: NRG; PAM sequence: AAG
tgatatgggaggttcacttg

SEQ ID NO: 8889 - DNA, 20 bp, Artificial Sequence
  Description of Artificial Sequence: Synthetic oligonucleotide
  Target: ANGPTL3; (+) strand; PAM type: NRG; PAM sequence: CAG
atgggaggttcacttgaagt

SEQ ID NO: 8890 - DNA, 20 bp, Artificial Sequence
  Description of Artificial Sequence: Synthetic oligonucleotide
  Target: ANGPTL3; (+) strand; PAM type: NRG; PAM sequence: AGG
tgggaggttcacttgaagtc

SEQ ID NO: 8891 - DNA, 20 bp, Artificial Sequence
  Description of Artificial Sequence: Synthetic oligonucleotide
  Target: ANGPTL3; (+) strand; PAM type: NRG; PAM sequence: GAG
ggaggttcacttgaagtcag

SEQ ID NO: 8892 - DNA, 20 bp, Artificial Sequence
  Description of Artificial Sequence: Synthetic oligonucleotide
  Target: ANGPTL3; (+) strand; PAM type: NRG; PAM sequence: AAG
tcacttgaagtcaggagttc

SEQ ID NO: 8893 - DNA, 20 bp, Artificial Sequence
  Description of Artificial Sequence: Synthetic oligonucleotide
  Target: ANGPTL3; (+) strand; PAM type: NRG; PAM sequence: AGG
cacttgaagtcaggagttca

SEQ ID NO: 8894 - DNA, 20 bp, Artificial Sequence
  Description of Artificial Sequence: Synthetic oligonucleotide
  Target: ANGPTL3; (+) strand; PAM type: NRG; PAM sequence: CAG
tgaagtcaggagttcaaggt

SEQ ID NO: 8895 - DNA, 20 bp, Artificial Sequence
  Description of Artificial Sequence: Synthetic oligonucleotide
  Target: ANGPTL3; (+) strand; PAM type: NRG; PAM sequence: TGG
tcaggagttcaaggtcagct

SEQ ID NO: 8896 - DNA, 20 bp, Artificial Sequence
  Description of Artificial Sequence: Synthetic oligonucleotide
  Target: ANGPTL3; (+) strand; PAM type: NRG; PAM sequence: GGG
caggagttcaaggtcagctt

SEQ ID NO: 8897 - DNA, 20 bp, Artificial Sequence
  Description of Artificial Sequence: Synthetic oligonucleotide
  Target: ANGPTL3; (+) strand; PAM type: NRG; PAM sequence: TAG
caaggtcagcttgggcaaca

SEQ ID NO: 8898 - DNA, 20 bp, Artificial Sequence
  Description of Artificial Sequence: Synthetic oligonucleotide
  Target: ANGPTL3; (+) strand; PAM type: NRG; PAM sequence: CAG
ttgggcaacatagtgaaaca

SEQ ID NO: 8899 - DNA, 20 bp, Artificial Sequence
  Description of Artificial Sequence: Synthetic oligonucleotide
  Target: ANGPTL3; (+) strand; PAM type: NRG; PAM sequence: TAG
tctacaaaatatttaaaaat

SEQ ID NO: 8900 - DNA, 20 bp, Artificial Sequence
  Description of Artificial Sequence: Synthetic oligonucleotide
  Target: ANGPTL3; (+) strand; PAM type: NRG; PAM sequence: TGG
caaaatatttaaaaattagc

SEQ ID NO: 8901 - DNA, 20 bp, Artificial Sequence
  Description of Artificial Sequence: Synthetic oligonucleotide
  Target: ANGPTL3; (+) strand; PAM type: NRG; PAM sequence: GGG
aaaatatttaaaaattagct

SEQ ID NO: 8902 - DNA, 20 bp, Artificial Sequence
  Description of Artificial Sequence: Synthetic oligonucleotide
  Target: ANGPTL3; (+) strand; PAM type: NRG; PAM sequence: TGG
atttaaaaattagctgggtg

SEQ ID NO: 8903 - DNA, 20 bp, Artificial Sequence
  Description of Artificial Sequence: Synthetic oligonucleotide
  Target: ANGPTL3; (+) strand; PAM type: NRG; PAM sequence: TGG
taaaaattagctgggtgtgg

SEQ ID NO: 8904 - DNA, 20 bp, Artificial Sequence
  Description of Artificial Sequence: Synthetic oligonucleotide
  Target: ANGPTL3; (+) strand; PAM type: NRG; PAM sequence: TAG
ggtgtggtggcatgcatcta

SEQ ID NO: 8905 - DNA, 20 bp, Artificial Sequence
  Description of Artificial Sequence: Synthetic oligonucleotide
  Target: ANGPTL3; (+) strand; PAM type: NRG; PAM sequence: CAG
gtggcatgcatctatagtct

SEQ ID NO: 8906 - DNA, 20 bp, Artificial Sequence
  Description of Artificial Sequence: Synthetic oligonucleotide
  Target: ANGPTL3; (+) strand; PAM type: NRG; PAM sequence: TGG
catctatagtctcagctact

SEQ ID NO: 8907 - DNA, 20 bp, Artificial Sequence
  Description of Artificial Sequence: Synthetic oligonucleotide
  Target: ANGPTL3; (+) strand; PAM type: NRG; PAM sequence: GGG
atctatagtctcagctactt

SEQ ID NO: 8908 - DNA, 20 bp, Artificial Sequence
  Description of Artificial Sequence: Synthetic oligonucleotide
  Target: ANGPTL3; (+) strand; PAM type: NRG; PAM sequence: GAG
ctatagtctcagctacttgg

SEQ ID NO: 8909 - DNA, 20 bp, Artificial Sequence
  Description of Artificial Sequence: Synthetic oligonucleotide
  Target: ANGPTL3; (+) strand; PAM type: NRG; PAM sequence: CAG
agtctcagctacttgggaga

SEQ ID NO: 8910 - DNA, 20 bp, Artificial Sequence
  Description of Artificial Sequence: Synthetic oligonucleotide
  Target: ANGPTL3; (+) strand; PAM type: NRG; PAM sequence: GAG
tctcagctacttgggagaca

SEQ ID NO: 8911 - DNA, 20 bp, Artificial Sequence
  Description of Artificial Sequence: Synthetic oligonucleotide
  Target: ANGPTL3; (+) strand; PAM type: NRG; PAM sequence: AGG
ctcagctacttgggagacag

SEQ ID NO: 8912 - DNA, 20 bp, Artificial Sequence
  Description of Artificial Sequence: Synthetic oligonucleotide
  Target: ANGPTL3; (+) strand; PAM type: NRG; PAM sequence: GGG
tcagctacttgggagacaga

SEQ ID NO: 8913 - DNA, 20 bp, Artificial Sequence
  Description of Artificial Sequence: Synthetic oligonucleotide
  Target: ANGPTL3; (+) strand; PAM type: NRG; PAM sequence: GAG
agctacttgggagacagagg

SEQ ID NO: 8914 - DNA, 20 bp, Artificial Sequence
  Description of Artificial Sequence: Synthetic oligonucleotide
  Target: ANGPTL3; (+) strand; PAM type: NRG; PAM sequence: AGG
gctacttgggagacagaggg

SEQ ID NO: 8915 - DNA, 20 bp, Artificial Sequence
  Description of Artificial Sequence: Synthetic oligonucleotide
  Target: ANGPTL3; (+) strand; PAM type: NRG; PAM sequence: GAG
tacttgggagacagagggag

SEQ ID NO: 8916 - DNA, 20 bp, Artificial Sequence
  Description of Artificial Sequence: Synthetic oligonucleotide
  Target: ANGPTL3; (+) strand; PAM type: NRG; PAM sequence: AGG
acttgggagacagagggagg

SEQ ID NO: 8917 - DNA, 20 bp, Artificial Sequence
  Description of Artificial Sequence: Synthetic oligonucleotide
  Target: ANGPTL3; (+) strand; PAM type: NRG; PAM sequence: GAG
cagagggaggaggcttgctc

SEQ ID NO: 8918 - DNA, 20 bp, Artificial Sequence
  Description of Artificial Sequence: Synthetic oligonucleotide
  Target: ANGPTL3; (+) strand; PAM type: NRG; PAM sequence: CAG
ggaggaggcttgctcgagcc

SEQ ID NO: 8919 - DNA, 20 bp, Artificial Sequence
  Description of Artificial Sequence: Synthetic oligonucleotide
  Target: ANGPTL3; (+) strand; PAM type: NRG; PAM sequence: AGG
gaggaggcttgctcgagccc

SEQ ID NO: 8920 - DNA, 20 bp, Artificial Sequence
  Description of Artificial Sequence: Synthetic oligonucleotide
  Target: ANGPTL3; (+) strand; PAM type: NRG; PAM sequence: GAG
ggaggcttgctcgagcccag

SEQ ID NO: 8921 - DNA, 20 bp, Artificial Sequence
  Description of Artificial Sequence: Synthetic oligonucleotide
  Target: ANGPTL3; (+) strand; PAM type: NRG; PAM sequence: TGG
tgctcgagcccaggagttcg

SEQ ID NO: 8922 - DNA, 20 bp, Artificial Sequence
  Description of Artificial Sequence: Synthetic oligonucleotide
  Target: ANGPTL3; (+) strand; PAM type: NRG; PAM sequence: TAG
agcccaggagttcgtggcta

SEQ ID NO: 8923 - DNA, 20 bp, Artificial Sequence
  Description of Artificial Sequence: Synthetic oligonucleotide
  Target: ANGPTL3; (+) strand; PAM type: NRG; PAM sequence: GAG
caggagttcgtggctatagt

SEQ ID NO: 8924 - DNA, 20 bp, Artificial Sequence
  Description of Artificial Sequence: Synthetic oligonucleotide
  Target: ANGPTL3; (+) strand; PAM type: NRG; PAM sequence: CAG
atgatcatgccactgcactc

SEQ ID NO: 8925 - DNA, 20 bp, Artificial Sequence
  Description of Artificial Sequence: Synthetic oligonucleotide
  Target: ANGPTL3; (+) strand; PAM type: NRG; PAM sequence: TGG
catgccactgcactccagcc

SEQ ID NO: 8926 - DNA, 20 bp, Artificial Sequence
  Description of Artificial Sequence: Synthetic oligonucleotide
  Target: ANGPTL3; (+) strand; PAM type: NRG; PAM sequence: CAG
ctgcactccagcctggacaa

SEQ ID NO: 8927 - DNA, 20 bp, Artificial Sequence
  Description of Artificial Sequence: Synthetic oligonucleotide
  Target: ANGPTL3; (+) strand; PAM type: NRG; PAM sequence: GAG
gcactccagcctggacaaca

SEQ ID NO: 8928 - DNA, 20 bp, Artificial Sequence
  Description of Artificial Sequence: Synthetic oligonucleotide
  Target: ANGPTL3; (+) strand; PAM type: NRG; PAM sequence: AAG
tccagcctggacaacagagc

SEQ ID NO: 8929 - DNA, 20 bp, Artificial Sequence
  Description of Artificial Sequence: Synthetic oligonucleotide
  Target: ANGPTL3; (+) strand; PAM type: NRG; PAM sequence: AAG
gcaagaccctgtctctaaaa

SEQ ID NO: 8930 - DNA, 20 bp, Artificial Sequence
  Description of Artificial Sequence: Synthetic oligonucleotide
  Target: ANGPTL3; (+) strand; PAM type: NRG; PAM sequence: AAG
accctgtctctaaaaaagaa

SEQ ID NO: 8931 - DNA, 20 bp, Artificial Sequence
  Description of Artificial Sequence: Synthetic oligonucleotide
  Target: ANGPTL3; (+) strand; PAM type: NRG; PAM sequence: TGG
tctaaaaaagaaaagaaatt

SEQ ID NO: 8932 - DNA, 20 bp, Artificial Sequence
  Description of Artificial Sequence: Synthetic oligonucleotide
  Target: ANGPTL3; (+) strand; PAM type: NRG; PAM sequence: TGG
aaagaaaagaaatttggaaa

SEQ ID NO: 8933 - DNA, 20 bp, Artificial Sequence
  Description of Artificial Sequence: Synthetic oligonucleotide
  Target: ANGPTL3; (+) strand; PAM type: NRG; PAM sequence: AAG
aaacttttccctgtgttaaa

SEQ ID NO: 8934 - DNA, 20 bp, Artificial Sequence
  Description of Artificial Sequence: Synthetic oligonucleotide
  Target: ANGPTL3; (+) strand; PAM type: NRG; PAM sequence: TAG
actttatgaaaaatttcttt

SEQ ID NO: 8935 - DNA, 20 bp, Artificial Sequence
  Description of Artificial Sequence: Synthetic oligonucleotide
  Target: ANGPTL3; (+) strand; PAM type: NRG; PAM sequence: AGG
ctttatgaaaaatttctttt

SEQ ID NO: 8936 - DNA, 20 bp, Artificial Sequence
  Description of Artificial Sequence: Synthetic oligonucleotide
  Target: ANGPTL3; (+) strand; PAM type: NRG; PAM sequence: AAG
atgaaaaatttcttttaggt

SEQ ID NO: 8937 - DNA, 20 bp, Artificial Sequence
  Description of Artificial Sequence: Synthetic oligonucleotide
  Target: ANGPTL3; (+) strand; PAM type: NRG; PAM sequence: AGG
tgaaaaatttcttttaggta

SEQ ID NO: 8938 - DNA, 20 bp, Artificial Sequence
  Description of Artificial Sequence: Synthetic oligonucleotide
  Target: ANGPTL3; (+) strand; PAM type: NRG; PAM sequence: CAG
tatatacccacacacataca

SEQ ID NO: 8939 - DNA, 20 bp, Artificial Sequence
  Description of Artificial Sequence: Synthetic oligonucleotide
  Target: ANGPTL3; (+) strand; PAM type: NRG; PAM sequence: AGG
atatacccacacacatacac

SEQ ID NO: 8940 - DNA, 20 bp, Artificial Sequence
  Description of Artificial Sequence: Synthetic oligonucleotide
  Target: ANGPTL3; (+) strand; PAM type: NRG; PAM sequence: AAG
cacacacatacacaggttaa

SEQ ID NO: 8941 - DNA, 20 bp, Artificial Sequence
  Description of Artificial Sequence: Synthetic oligonucleotide
  Target: ANGPTL3; (+) strand; PAM type: NRG; PAM sequence: TAG
cacatacacaggttaaaagt

SEQ ID NO: 8942 - DNA, 20 bp, Artificial Sequence
  Description of Artificial Sequence: Synthetic oligonucleotide
  Target: ANGPTL3; (+) strand; PAM type: NRG; PAM sequence: TAG
gtttcatgtgacataataac

SEQ ID NO: 8943 - DNA, 20 bp, Artificial Sequence
  Description of Artificial Sequence: Synthetic oligonucleotide
  Target: ANGPTL3; (+) strand; PAM type: NRG; PAM sequence: GAG
gacataataactagcatttt

SEQ ID NO: 8944 - DNA, 20 bp, Artificial Sequence
  Description of Artificial Sequence: Synthetic oligonucleotide
  Target: ANGPTL3; (+) strand; PAM type: NRG; PAM sequence: CAG
ttgagcactacctgtttgcc

SEQ ID NO: 8945 - DNA, 20 bp, Artificial Sequence
  Description of Artificial Sequence: Synthetic oligonucleotide
  Target: ANGPTL3; (+) strand; PAM type: NRG; PAM sequence: AAG
tgtttgcccagcactgttct

SEQ ID NO: 8946 - DNA, 20 bp, Artificial Sequence
  Description of Artificial Sequence: Synthetic oligonucleotide
  Target: ANGPTL3; (+) strand; PAM type: NRG; PAM sequence: CAG
attatgtactataattaccc

SEQ ID NO: 8947 - DNA, 20 bp, Artificial Sequence
  Description of Artificial Sequence: Synthetic oligonucleotide
  Target: ANGPTL3; (+) strand; PAM type: NRG; PAM sequence: CAG
ctataattaccccagcttta

SEQ ID NO: 8948 - DNA, 20 bp, Artificial Sequence
  Description of Artificial Sequence: Synthetic oligonucleotide
  Target: ANGPTL3; (+) strand; PAM type: NRG; PAM sequence: GAG
attaccccagctttacagat

SEQ ID NO: 8949 - DNA, 20 bp, Artificial Sequence
  Description of Artificial Sequence: Synthetic oligonucleotide
  Target: ANGPTL3; (+) strand; PAM type: NRG; PAM sequence: AGG
ttaccccagctttacagatg

SEQ ID NO: 8950 - DNA, 20 bp, Artificial Sequence
  Description of Artificial Sequence: Synthetic oligonucleotide
  Target: ANGPTL3; (+) strand; PAM type: NRG; PAM sequence: GAG
accccagctttacagatgag

SEQ ID NO: 8951 - DNA, 20 bp, Artificial Sequence
  Description of Artificial Sequence: Synthetic oligonucleotide
  Target: ANGPTL3; (+) strand; PAM type: NRG; PAM sequence: TGG
cagatgaggagactaatcca

SEQ ID NO: 8952 - DNA, 20 bp, Artificial Sequence
  Description of Artificial Sequence: Synthetic oligonucleotide
  Target: ANGPTL3; (+) strand; PAM type: NRG; PAM sequence: GGG
agatgaggagactaatccat

SEQ ID NO: 8953 - DNA, 20 bp, Artificial Sequence
  Description of Artificial Sequence: Synthetic oligonucleotide
  Target: ANGPTL3; (+) strand; PAM type: NRG; PAM sequence: GGG
gatgaggagactaatccatg

SEQ ID NO: 8954 - DNA, 20 bp, Artificial Sequence
  Description of Artificial Sequence: Synthetic oligonucleotide
  Target: ANGPTL3; (+) strand; PAM type: NRG; PAM sequence: GAG
tgaggagactaatccatggg

SEQ ID NO: 8955 - DNA, 20 bp, Artificial Sequence
  Description of Artificial Sequence: Synthetic oligonucleotide
  Target: ANGPTL3; (+) strand; PAM type: NRG; PAM sequence: AGG
gaggagactaatccatgggg

SEQ ID NO: 8956 - DNA, 20 bp, Artificial Sequence
  Description of Artificial Sequence: Synthetic oligonucleotide
  Target: ANGPTL3; (+) strand; PAM type: NRG; PAM sequence: AAG
gactaatccatggggaggtt

SEQ ID NO: 8957 - DNA, 20 bp, Artificial Sequence
  Description of Artificial Sequence: Synthetic oligonucleotide
  Target: ANGPTL3; (+) strand; PAM type: NRG; PAM sequence: AAG
ggaggttaagtaacttgtcc

SEQ ID NO: 8958 - DNA, 20 bp, Artificial Sequence
  Description of Artificial Sequence: Synthetic oligonucleotide
  Target: ANGPTL3; (+) strand; PAM type: NRG; PAM sequence: AGG
gaggttaagtaacttgtcca

SEQ ID NO: 8959 - DNA, 20 bp, Artificial Sequence
  Description of Artificial Sequence: Synthetic oligonucleotide
  Target: ANGPTL3; (+) strand; PAM type: NRG; PAM sequence: CAG
ttaagtaacttgtccaaggc

SEQ ID NO: 8960 - DNA, 20 bp, Artificial Sequence
  Description of Artificial Sequence: Synthetic oligonucleotide
  Target: ANGPTL3; (+) strand; PAM type: NRG; PAM sequence: CAG
gtaacttgtccaaggccaga

SEQ ID NO: 8961 - DNA, 20 bp, Artificial Sequence
  Description of Artificial Sequence: Synthetic oligonucleotide
  Target: ANGPTL3; (+) strand; PAM type: NRG; PAM sequence: TAG
cttgtccaaggccagacagc

SEQ ID NO: 8962 - DNA, 20 bp, Artificial Sequence
  Description of Artificial Sequence: Synthetic oligonucleotide
  Target: ANGPTL3; (+) strand; PAM type: NRG; PAM sequence: GAG
tgtccaaggccagacagcta

SEQ ID NO: 8963 - DNA, 20 bp, Artificial Sequence
  Description of Artificial Sequence: Synthetic oligonucleotide
  Target: ANGPTL3; (+) strand; PAM type: NRG; PAM sequence: CGG
caaggccagacagctagagc

SEQ ID NO: 8964 - DNA, 20 bp, Artificial Sequence
  Description of Artificial Sequence: Synthetic oligonucleotide
  Target: ANGPTL3; (+) strand; PAM type: NRG; PAM sequence: TGG
agacagctagagccggcttt

SEQ ID NO: 8965 - DNA, 20 bp, Artificial Sequence
  Description of Artificial Sequence: Synthetic oligonucleotide
  Target: ANGPTL3; (+) strand; PAM type: NRG; PAM sequence: CAG
cggcttttggacccacacca

SEQ ID NO: 8966 - DNA, 20 bp, Artificial Sequence
  Description of Artificial Sequence: Synthetic oligonucleotide
  Target: ANGPTL3; (+) strand; PAM type: NRG; PAM sequence: CAG
cccacaccacagtctgactc

SEQ ID NO: 8967 - DNA, 20 bp, Artificial Sequence
  Description of Artificial Sequence: Synthetic oligonucleotide
  Target: ANGPTL3; (+) strand; PAM type: NRG; PAM sequence: AAG
tttcaccatattaatatgtc

SEQ ID NO: 8968 - DNA, 20 bp, Artificial Sequence
  Description of Artificial Sequence: Synthetic oligonucleotide
  Target: ANGPTL3; (+) strand; PAM type: NRG; PAM sequence: AAG
catattaatatgtcaagatt

SEQ ID NO: 8969 - DNA, 20 bp, Artificial Sequence
  Description of Artificial Sequence: Synthetic oligonucleotide
  Target: ANGPTL3; (+) strand; PAM type: NRG; PAM sequence: CAG
attaatatgtcaagattaag

SEQ ID NO: 8970 - DNA, 20 bp, Artificial Sequence
  Description of Artificial Sequence: Synthetic oligonucleotide
  Target: ANGPTL3; (+) strand; PAM type: NRG; PAM sequence: AAG
gtcaagattaagcagtttta

SEQ ID NO: 8971 - DNA, 20 bp, Artificial Sequence
  Description of Artificial Sequence: Synthetic oligonucleotide
  Target: ANGPTL3; (+) strand; PAM type: NRG; PAM sequence: AGG
tcaagattaagcagttttaa

SEQ ID NO: 8972 - DNA, 20 bp, Artificial Sequence
  Description of Artificial Sequence: Synthetic oligonucleotide
  Target: ANGPTL3; (+) strand; PAM type: NRG; PAM sequence: AAG
tcttaatatgaacactcaat

SEQ ID NO: 8973 - DNA, 20 bp, Artificial Sequence
  Description of Artificial Sequence: Synthetic oligonucleotide
  Target: ANGPTL3; (+) strand; PAM type: NRG; PAM sequence: AAG
ataagaataatcactaatat

SEQ ID NO: 8974 - DNA, 20 bp, Artificial Sequence
  Description of Artificial Sequence: Synthetic oligonucleotide
  Target: ANGPTL3; (+) strand; PAM type: NRG; PAM sequence: TAG
taatcactaatataagcatt

SEQ ID NO: 8975 - DNA, 20 bp, Artificial Sequence
  Description of Artificial Sequence: Synthetic oligonucleotide
  Target: ANGPTL3; (+) strand; PAM type: NRG; PAM sequence: AAG
tttagtatttttttaacact

SEQ ID NO: 8976 - DNA, 20 bp, Artificial Sequence
  Description of Artificial Sequence: Synthetic oligonucleotide
  Target: ANGPTL3; (+) strand; PAM type: NRG; PAM sequence: TGG
gtatttttttaacactaagt

SEQ ID NO: 8977 - DNA, 20 bp, Artificial Sequence
  Description of Artificial Sequence: Synthetic oligonucleotide
  Target: ANGPTL3; (+) strand; PAM type: NRG; PAM sequence: AAG
tttttttaacactaagttgg

SEQ ID NO: 8978 - DNA, 20 bp, Artificial Sequence
  Description of Artificial Sequence: Synthetic oligonucleotide
  Target: ANGPTL3; (+) strand; PAM type: NRG; PAM sequence: TAG
ttaacactaagttggaagca

SEQ ID NO: 8979 - DNA, 20 bp, Artificial Sequence
  Description of Artificial Sequence: Synthetic oligonucleotide
  Target: ANGPTL3; (+) strand; PAM type: NRG; PAM sequence: TGG
acactaagttggaagcatag

SEQ ID NO: 8980 - DNA, 20 bp, Artificial Sequence
  Description of Artificial Sequence: Synthetic oligonucleotide
  Target: ANGPTL3; (+) strand; PAM type: NRG; PAM sequence: TAG
catagtggaacatttatttt

SEQ ID NO: 8981 - DNA, 20 bp, Artificial Sequence
  Description of Artificial Sequence: Synthetic oligonucleotide
  Target: ANGPTL3; (+) strand; PAM type: NRG; PAM sequence: TGG
tttttagaaatattattaat

SEQ ID NO: 8982 - DNA, 20 bp, Artificial Sequence
  Description of Artificial Sequence: Synthetic oligonucleotide
  Target: ANGPTL3; (+) strand; PAM type: NRG; PAM sequence: TGG
tagaaatattattaattggc

SEQ ID NO: 8983 - DNA, 20 bp, Artificial Sequence
  Description of Artificial Sequence: Synthetic oligonucleotide
  Target: ANGPTL3; (+) strand; PAM type: NRG; PAM sequence: GGG
agaaatattattaattggct

SEQ ID NO: 8984 - DNA, 20 bp, Artificial Sequence
  Description of Artificial Sequence: Synthetic oligonucleotide
  Target: ANGPTL3; (+) strand; PAM type: NRG; PAM sequence: CGG
gctgggctcacgcttgtaat

SEQ ID NO: 8985 - DNA, 20 bp, Artificial Sequence
  Description of Artificial Sequence: Synthetic oligonucleotide
  Target: ANGPTL3; (+) strand; PAM type: NRG; PAM sequence: TGG
ggctcacgcttgtaatcggc

SEQ ID NO: 8986 - DNA, 20 bp, Artificial Sequence
  Description of Artificial Sequence: Synthetic oligonucleotide
  Target: ANGPTL3; (+) strand; PAM type: NRG; PAM sequence: GGG
gctcacgcttgtaatcggct

SEQ ID NO: 8987 - DNA, 20 bp, Artificial Sequence
  Description of Artificial Sequence: Synthetic oligonucleotide
  Target: ANGPTL3; (+) strand; PAM type: NRG; PAM sequence: TGG
gggctcatgcctgtaaattt

SEQ ID NO: 8988 - DNA, 20 bp, Artificial Sequence
  Description of Artificial Sequence: Synthetic oligonucleotide
  Target: ANGPTL3; (+) strand; PAM type: NRG; PAM sequence: GGG
ggctcatgcctgtaaatttt

SEQ ID NO: 8989 - DNA, 20 bp, Artificial Sequence
  Description of Artificial Sequence: Synthetic oligonucleotide
  Target: ANGPTL3; (+) strand; PAM type: NRG; PAM sequence: GAG
ctcatgcctgtaaattttgg

SEQ ID NO: 8990 - DNA, 20 bp, Artificial Sequence
  Description of Artificial Sequence: Synthetic oligonucleotide
  Target: ANGPTL3; (+) strand; PAM type: NRG; PAM sequence: AGG
tcatgcctgtaaattttggg

SEQ ID NO: 8991 - DNA, 20 bp, Artificial Sequence
  Description of Artificial Sequence: Synthetic oligonucleotide
  Target: ANGPTL3; (+) strand; PAM type: NRG; PAM sequence: AAG
cctgtaaattttgggaggcc

SEQ ID NO: 8992 - DNA, 20 bp, Artificial Sequence
  Description of Artificial Sequence: Synthetic oligonucleotide
  Target: ANGPTL3; (+) strand; PAM type: NRG; PAM sequence: AGG
ctgtaaattttgggaggcca

SEQ ID NO: 8993 - DNA, 20 bp, Artificial Sequence
  Description of Artificial Sequence: Synthetic oligonucleotide
  Target: ANGPTL3; (+) strand; PAM type: NRG; PAM sequence: AAG
attttgggaggccaaggtaa

SEQ ID NO: 8994 - DNA, 20 bp, Artificial Sequence
  Description of Artificial Sequence: Synthetic oligonucleotide
  Target: ANGPTL3; (+) strand; PAM type: NRG; PAM sequence: GAG
ccaaggtaaaagaattgctt

SEQ ID NO: 8995 - DNA, 20 bp, Artificial Sequence
  Description of Artificial Sequence: Synthetic oligonucleotide
  Target: ANGPTL3; (+) strand; PAM type: NRG; PAM sequence: CAG
gtaaaagaattgcttgagcc

SEQ ID NO: 8996 - DNA, 20 bp, Artificial Sequence
  Description of Artificial Sequence: Synthetic oligonucleotide
  Target: ANGPTL3; (+) strand; PAM type: NRG; PAM sequence: CAG
ttgcttgagcccagtatttc

SEQ ID NO: 8997 - DNA, 20 bp, Artificial Sequence
  Description of Artificial Sequence: Synthetic oligonucleotide
  Target: ANGPTL3; (+) strand; PAM type: NRG; PAM sequence: CAG
tgagcccagtatttccagac

SEQ ID NO: 8998 - DNA, 20 bp, Artificial Sequence
  Description of Artificial Sequence: Synthetic oligonucleotide
  Target: ANGPTL3; (+) strand; PAM type: NRG; PAM sequence: TGG
ccagtatttccagaccagca

SEQ ID NO: 8999 - DNA, 20 bp, Artificial Sequence
  Description of Artificial Sequence: Synthetic oligonucleotide
  Target: ANGPTL3; (+) strand; PAM type: NRG; PAM sequence: GGG
cagtatttccagaccagcat

SEQ ID NO: 9000 - DNA, 20 bp, Artificial Sequence
  Description of Artificial Sequence: Synthetic oligonucleotide
  Target: ANGPTL3; (+) strand; PAM type: NRG; PAM sequence: AAG
accagcatgggcaatacatt

SEQ ID NO: 9001 - DNA, 20 bp, Artificial Sequence
  Description of Artificial Sequence: Synthetic oligonucleotide
  Target: ANGPTL3; (+) strand; PAM type: NRG; PAM sequence: AAG
atattatcaaaattgttact

SEQ ID NO: 9002 - DNA, 20 bp, Artificial Sequence
  Description of Artificial Sequence: Synthetic oligonucleotide
  Target: ANGPTL3; (+) strand; PAM type: NRG; PAM sequence: CAG
gttactaagctaacaaactt

SEQ ID NO: 9003 - DNA, 20 bp, Artificial Sequence
  Description of Artificial Sequence: Synthetic oligonucleotide
  Target: ANGPTL3; (+) strand; PAM type: NRG; PAM sequence: TGG
aacttcagaaaaacttatga

SEQ ID NO: 9004 - DNA, 20 bp, Artificial Sequence
  Description of Artificial Sequence: Synthetic oligonucleotide
  Target: ANGPTL3; (+) strand; PAM type: NRG; PAM sequence: GGG
acttcagaaaaacttatgat

SEQ ID NO: 9005 - DNA, 20 bp, Artificial Sequence
  Description of Artificial Sequence: Synthetic oligonucleotide
  Target: ANGPTL3; (+) strand; PAM type: NRG; PAM sequence: AAG
cagaaaaacttatgatgggc

SEQ ID NO: 9006 - DNA, 20 bp, Artificial Sequence
  Description of Artificial Sequence: Synthetic oligonucleotide
  Target: ANGPTL3; (+) strand; PAM type: NRG; PAM sequence: AAG
gcaagctgcttgtgacattg

SEQ ID NO: 9007 - DNA, 20 bp, Artificial Sequence
  Description of Artificial Sequence: Synthetic oligonucleotide
  Target: ANGPTL3; (+) strand; PAM type: NRG; PAM sequence: AGG
caagctgcttgtgacattga

SEQ ID NO: 9008 - DNA, 20 bp, Artificial Sequence
  Description of Artificial Sequence: Synthetic oligonucleotide
  Target: ANGPTL3; (+) strand; PAM type: NRG; PAM sequence: AAG
ttgtgacattgaaggtattt

SEQ ID NO: 9009 - DNA, 20 bp, Artificial Sequence
  Description of Artificial Sequence: Synthetic oligonucleotide
  Target: ANGPTL3; (+) strand; PAM type: NRG; PAM sequence: TAG
aggtatttaagattcaattc

SEQ ID NO: 9010 - DNA, 20 bp, Artificial Sequence
  Description of Artificial Sequence: Synthetic oligonucleotide
  Target: ANGPTL3; (+) strand; PAM type: NRG; PAM sequence: TGG
tttaagattcaattctagtt

SEQ ID NO: 9011 - DNA, 20 bp, Artificial Sequence
  Description of Artificial Sequence: Synthetic oligonucleotide
  Target: ANGPTL3; (+) strand; PAM type: NRG; PAM sequence: TAG
attcaattctagtttggtcc

SEQ ID NO: 9012 - DNA, 20 bp, Artificial Sequence
  Description of Artificial Sequence: Synthetic oligonucleotide
  Target: ANGPTL3; (+) strand; PAM type: NRG; PAM sequence: GAG
atatccattgttccttcaac

SEQ ID NO: 9013 - DNA, 20 bp, Artificial Sequence
  Description of Artificial Sequence: Synthetic oligonucleotide
  Target: ANGPTL3; (+) strand; PAM type: NRG; PAM sequence: TGG
ttgttccttcaacgagcaca

SEQ ID NO: 9014 - DNA, 20 bp, Artificial Sequence
  Description of Artificial Sequence: Synthetic oligonucleotide
  Target: ANGPTL3; (+) strand; PAM type: NRG; PAM sequence: AAG
ccttcaacgagcacatggta

SEQ ID NO: 9015 - DNA, 20 bp, Artificial Sequence
  Description of Artificial Sequence: Synthetic oligonucleotide
  Target: ANGPTL3; (+) strand; PAM type: NRG; PAM sequence: GAG
ttcaacgagcacatggtaaa

SEQ ID NO: 9016 - DNA, 20 bp, Artificial Sequence
  Description of Artificial Sequence: Synthetic oligonucleotide
  Target: ANGPTL3; (+) strand; PAM type: NRG; PAM sequence: TAG
cgagcacatggtaaagagcc

SEQ ID NO: 9017 - DNA, 20 bp, Artificial Sequence
  Description of Artificial Sequence: Synthetic oligonucleotide
  Target: ANGPTL3; (+) strand; PAM type: NRG; PAM sequence: CAG
atggtaaagagcctagaaca

SEQ ID NO: 9018 - DNA, 20 bp, Artificial Sequence
  Description of Artificial Sequence: Synthetic oligonucleotide
  Target: ANGPTL3; (+) strand; PAM type: NRG; PAM sequence: GAG
ggtaaagagcctagaacaca

SEQ ID NO: 9019 - DNA, 20 bp, Artificial Sequence
  Description of Artificial Sequence: Synthetic oligonucleotide
  Target: ANGPTL3; (+) strand; PAM type: NRG; PAM sequence: CAG
gagcctagaacacagagaca

SEQ ID NO: 9020 - DNA, 20 bp, Artificial Sequence
  Description of Artificial Sequence: Synthetic oligonucleotide
  Target: ANGPTL3; (+) strand; PAM type: NRG; PAM sequence: CAG
gaacacagagacacagaaca

SEQ ID NO: 9021 - DNA, 20 bp, Artificial Sequence
  Description of Artificial Sequence: Synthetic oligonucleotide
  Target: ANGPTL3; (+) strand; PAM type: NRG; PAM sequence: TGG
cacagagacacagaacacag

SEQ ID NO: 9022 - DNA, 20 bp, Artificial Sequence
  Description of Artificial Sequence: Synthetic oligonucleotide
  Target: ANGPTL3; (+) strand; PAM type: NRG; PAM sequence: GAG
cagagacacagaacacagtg

SEQ ID NO: 9023 - DNA, 20 bp, Artificial Sequence
  Description of Artificial Sequence: Synthetic oligonucleotide
  Target: ANGPTL3; (+) strand; PAM type: NRG; PAM sequence: AAG
acacagaacacagtggagaa

SEQ ID NO: 9024 - DNA, 20 bp, Artificial Sequence
  Description of Artificial Sequence: Synthetic oligonucleotide
  Target: ANGPTL3; (+) strand; PAM type: NRG; PAM sequence: AGG
cacagaacacagtggagaaa

SEQ ID NO: 9025 - DNA, 20 bp, Artificial Sequence
  Description of Artificial Sequence: Synthetic oligonucleotide
  Target: ANGPTL3; (+) strand; PAM type: NRG; PAM sequence: GGG
acagaacacagtggagaaaa

SEQ ID NO: 9026 - DNA, 20 bp, Artificial Sequence
  Description of Artificial Sequence: Synthetic oligonucleotide
  Target: ANGPTL3; (+) strand; PAM type: NRG; PAM sequence: GAG
agaacacagtggagaaaagg

SEQ ID NO: 9027 - DNA, 20 bp, Artificial Sequence
  Description of Artificial Sequence: Synthetic oligonucleotide
  Target: ANGPTL3; (+) strand; PAM type: NRG; PAM sequence: TGG
ttaatgacacttactatata

SEQ ID NO: 9028 - DNA, 20 bp, Artificial Sequence
  Description of Artificial Sequence: Synthetic oligonucleotide
  Target: ANGPTL3; (+) strand; PAM type: NRG; PAM sequence: GGG
taatgacacttactatatat

SEQ ID NO: 9029 - DNA, 20 bp, Artificial Sequence
  Description of Artificial Sequence: Synthetic oligonucleotide
  Target: ANGPTL3; (+) strand; PAM type: NRG; PAM sequence: AAG
gggattttgtgacaatatac

SEQ ID NO: 9030 - DNA, 20 bp, Artificial Sequence
  Description of Artificial Sequence: Synthetic oligonucleotide
  Target: ANGPTL3; (+) strand; PAM type: NRG; PAM sequence: AGG
ggattttgtgacaatataca

SEQ ID NO: 9031 - DNA, 20 bp, Artificial Sequence
  Description of Artificial Sequence: Synthetic oligonucleotide
  Target: ANGPTL3; (+) strand; PAM type: NRG; PAM sequence: TGG
tttgtgacaatatacaagga

SEQ ID NO: 9032 - DNA, 20 bp, Artificial Sequence
  Description of Artificial Sequence: Synthetic oligonucleotide
  Target: ANGPTL3; (+) strand; PAM type: NRG; PAM sequence: AAG
gacaatatacaaggatggtt

SEQ ID NO: 9033 - DNA, 20 bp, Artificial Sequence
  Description of Artificial Sequence: Synthetic oligonucleotide
  Target: ANGPTL3; (+) strand; PAM type: NRG; PAM sequence: AAG
caaggatggttaagacatat

SEQ ID NO: 9034 - DNA, 20 bp, Artificial Sequence
  Description of Artificial Sequence: Synthetic oligonucleotide
  Target: ANGPTL3; (+) strand; PAM type: NRG; PAM sequence: AGG
aaggatggttaagacatata

SEQ ID NO: 9035 - DNA, 20 bp, Artificial Sequence
  Description of Artificial Sequence: Synthetic oligonucleotide
  Target: ANGPTL3; (+) strand; PAM type: NRG; PAM sequence: TAG
aaaaaacatattaacaatta

SEQ ID NO: 9036 - DNA, 20 bp, Artificial Sequence
  Description of Artificial Sequence: Synthetic oligonucleotide
  Target: ANGPTL3; (+) strand; PAM type: NRG; PAM sequence: GAG
caattatagtgacaaaaaat

SEQ ID NO: 9037 - DNA, 20 bp, Artificial Sequence
  Description of Artificial Sequence: Synthetic oligonucleotide
  Target: ANGPTL3; (+) strand; PAM type: NRG; PAM sequence: AGG
aattatagtgacaaaaaatg

SEQ ID NO: 9038 - DNA, 20 bp, Artificial Sequence
  Description of Artificial Sequence: Synthetic oligonucleotide
  Target: ANGPTL3; (+) strand; PAM type: NRG; PAM sequence: GAG
ttatagtgacaaaaaatgag

SEQ ID NO: 9039 - DNA, 20 bp, Artificial Sequence
  Description of Artificial Sequence: Synthetic oligonucleotide
  Target: ANGPTL3; (+) strand; PAM type: NRG; PAM sequence: CAG
taattatacattgatttata

SEQ ID NO: 9040 - DNA, 20 bp, Artificial Sequence
  Description of Artificial Sequence: Synthetic oligonucleotide
  Target: ANGPTL3; (+) strand; PAM type: NRG; PAM sequence: GAG
attatacattgatttataca

SEQ ID NO: 9041 - DNA, 20 bp, Artificial Sequence
  Description of Artificial Sequence: Synthetic oligonucleotide
  Target: ANGPTL3; (+) strand; PAM type: NRG; PAM sequence: CAG
cattgatttatacagagtac

SEQ ID NO: 9042 - DNA, 20 bp, Artificial Sequence
  Description of Artificial Sequence: Synthetic oligonucleotide
  Target: ANGPTL3; (+) strand; PAM type: NRG; PAM sequence: GAG
ttgatttatacagagtacca

SEQ ID NO: 9043 - DNA, 20 bp, Artificial Sequence
  Description of Artificial Sequence: Synthetic oligonucleotide
  Target: ANGPTL3; (+) strand; PAM type: NRG; PAM sequence: AGG
tgatttatacagagtaccag

SEQ ID NO: 9044 - DNA, 20 bp, Artificial Sequence
  Description of Artificial Sequence: Synthetic oligonucleotide
  Target: ANGPTL3; (+) strand; PAM type: NRG; PAM sequence: CAG
tacagagtaccagaggaaca

SEQ ID NO: 9045 - DNA, 20 bp, Artificial Sequence
  Description of Artificial Sequence: Synthetic oligonucleotide
  Target: ANGPTL3; (+) strand; PAM type: NRG; PAM sequence: GAG
taccagaggaacacagcatt

SEQ ID NO: 9046 - DNA, 20 bp, Artificial Sequence
  Description of Artificial Sequence: Synthetic oligonucleotide
  Target: ANGPTL3; (+) strand; PAM type: NRG; PAM sequence: GAG
ccagaggaacacagcattga

SEQ ID NO: 9047 - DNA, 20 bp, Artificial Sequence
  Description of Artificial Sequence: Synthetic oligonucleotide
  Target: ANGPTL3; (+) strand; PAM type: NRG; PAM sequence: GAG
tgagagccgtaacaccacct

SEQ ID NO: 9048 - DNA, 20 bp, Artificial Sequence
  Description of Artificial Sequence: Synthetic oligonucleotide
  Target: ANGPTL3; (+) strand; PAM type: NRG; PAM sequence: AGG
gagagccgtaacaccacctg

SEQ ID NO: 9049 - DNA, 20 bp, Artificial Sequence
  Description of Artificial Sequence: Synthetic oligonucleotide
  Target: ANGPTL3; (+) strand; PAM type: NRG; PAM sequence: GGG
agagccgtaacaccacctga

SEQ ID NO: 9050 - DNA, 20 bp, Artificial Sequence
  Description of Artificial Sequence: Synthetic oligonucleotide
  Target: ANGPTL3; (+) strand; PAM type: NRG; PAM sequence: GAG
agccgtaacaccacctgagg

SEQ ID NO: 9051 - DNA, 20 bp, Artificial Sequence
  Description of Artificial Sequence: Synthetic oligonucleotide
  Target: ANGPTL3; (+) strand; PAM type: NRG; PAM sequence: TGG
cgtaacaccacctgagggag

SEQ ID NO: 9052 - DNA, 20 bp, Artificial Sequence
  Description of Artificial Sequence: Synthetic oligonucleotide
  Target: ANGPTL3; (+) strand; PAM type: NRG; PAM sequence: GAG
taacaccacctgagggagtg

SEQ ID NO: 9053 - DNA, 20 bp, Artificial Sequence
  Description of Artificial Sequence: Synthetic oligonucleotide
  Target: ANGPTL3; (+) strand; PAM type: NRG; PAM sequence: AAG
accacctgagggagtggaga

SEQ ID NO: 9054 - DNA, 20 bp, Artificial Sequence
  Description of Artificial Sequence: Synthetic oligonucleotide
  Target: ANGPTL3; (+) strand; PAM type: NRG; PAM sequence: AGG
ccacctgagggagtggagaa

SEQ ID NO: 9055 - DNA, 20 bp, Artificial Sequence
  Description of Artificial Sequence: Synthetic oligonucleotide
  Target: ANGPTL3; (+) strand; PAM type: NRG; PAM sequence: CAG
gagggagtggagaaaggctt

SEQ ID NO: 9056 - DNA, 20 bp, Artificial Sequence
  Description of Artificial Sequence: Synthetic oligonucleotide
  Target: ANGPTL3; (+) strand; PAM type: NRG; PAM sequence: GAG
gggagtggagaaaggcttca

SEQ ID NO: 9057 - DNA, 20 bp, Artificial Sequence
  Description of Artificial Sequence: Synthetic oligonucleotide
  Target: ANGPTL3; (+) strand; PAM type: NRG; PAM sequence: GAG
gagtggagaaaggcttcaga

SEQ ID NO: 9058 - DNA, 20 bp, Artificial Sequence
  Description of Artificial Sequence: Synthetic oligonucleotide
  Target: ANGPTL3; (+) strand; PAM type: NRG; PAM sequence: AAG
ggagaaaggcttcagagaga

SEQ ID NO: 9059 - DNA, 20 bp, Artificial Sequence
  Description of Artificial Sequence: Synthetic oligonucleotide
  Target: ANGPTL3; (+) strand; PAM type: NRG; PAM sequence: TGG
ttcagagagaaagtgttttt

SEQ ID NO: 9060 - DNA, 20 bp, Artificial Sequence
  Description of Artificial Sequence: Synthetic oligonucleotide
  Target: ANGPTL3; (+) strand; PAM type: NRG; PAM sequence: TGG
agagaaagtgttttttggaa

SEQ ID NO: 9061 - DNA, 20 bp, Artificial Sequence
  Description of Artificial Sequence: Synthetic oligonucleotide
  Target: ANGPTL3; (+) strand; PAM type: NRG; PAM sequence: AAG
gaatggatcactgtttccaa

SEQ ID NO: 9062 - DNA, 20 bp, Artificial Sequence
  Description of Artificial Sequence: Synthetic oligonucleotide
  Target: ANGPTL3; (+) strand; PAM type: NRG; PAM sequence: AAG
cactgtttccaaaagaacta

SEQ ID NO: 9063 - DNA, 20 bp, Artificial Sequence
  Description of Artificial Sequence: Synthetic oligonucleotide
  Target: ANGPTL3; (+) strand; PAM type: NRG; PAM sequence: CAG
tttccaaaagaactaaagta

SEQ ID NO: 9064 - DNA, 20 bp, Artificial Sequence
  Description of Artificial Sequence: Synthetic oligonucleotide
  Target: ANGPTL3; (+) strand; PAM type: NRG; PAM sequence: GAG
aaagaactaaagtacagttt

SEQ ID NO: 9065 - DNA, 20 bp, Artificial Sequence
  Description of Artificial Sequence: Synthetic oligonucleotide
  Target: ANGPTL3; (+) strand; PAM type: NRG; PAM sequence: AAG
aataaatttacccaacaaaa

SEQ ID NO: 9066 - DNA, 20 bp, Artificial Sequence
  Description of Artificial Sequence: Synthetic oligonucleotide
  Target: ANGPTL3; (+) strand; PAM type: NRG; PAM sequence: AAG
aatctcttaaaatcataaaa

SEQ ID NO: 9067 - DNA, 20 bp, Artificial Sequence
  Description of Artificial Sequence: Synthetic oligonucleotide
  Target: ANGPTL3; (+) strand; PAM type: NRG; PAM sequence: TAG
aaatcataaaaaagtaaaat

SEQ ID NO: 9068 - DNA, 20 bp, Artificial Sequence
  Description of Artificial Sequence: Synthetic oligonucleotide
  Target: ANGPTL3; (+) strand; PAM type: NRG; PAM sequence: CAG
gtaaaattagcttttaaaaa

SEQ ID NO: 9069 - DNA, 20 bp, Artificial Sequence
  Description of Artificial Sequence: Synthetic oligonucleotide
  Target: ANGPTL3; (+) strand; PAM type: NRG; PAM sequence: AGG
taaaattagcttttaaaaac

SEQ ID NO: 9070 - DNA, 20 bp, Artificial Sequence
  Description of Artificial Sequence: Synthetic oligonucleotide
  Target: ANGPTL3; (+) strand; PAM type: NRG; PAM sequence: TAG
aattagcttttaaaaacagg

SEQ ID NO: 9071 - DNA, 20 bp, Artificial Sequence
  Description of Artificial Sequence: Synthetic oligonucleotide
  Target: ANGPTL3; (+) strand; PAM type: NRG; PAM sequence: TAG
ttaaaaacaggtagtcacca

SEQ ID NO: 9072 - DNA, 20 bp, Artificial Sequence
  Description of Artificial Sequence: Synthetic oligonucleotide
  Target: ANGPTL3; (+) strand; PAM type: NRG; PAM sequence: TAG
tcaccatagcattgaatgtg

SEQ ID NO: 9073 - DNA, 20 bp, Artificial Sequence
  Description of Artificial Sequence: Synthetic oligonucleotide
  Target: ANGPTL3; (+) strand; PAM type: NRG; PAM sequence: CAG
tgaatgtgtagtttataata

SEQ ID NO: 9074 - DNA, 20 bp, Artificial Sequence
  Description of Artificial Sequence: Synthetic oligonucleotide
  Target: ANGPTL3; (+) strand; PAM type: NRG; PAM sequence: AAG
gtgtagtttataatacagca

SEQ ID NO: 9075 - DNA, 20 bp, Artificial Sequence
  Description of Artificial Sequence: Synthetic oligonucleotide
  Target: ANGPTL3; (+) strand; PAM type: NRG; PAM sequence: AAG
acaatttcaaattacctatt

SEQ ID NO: 9076 - DNA, 20 bp, Artificial Sequence
  Description of Artificial Sequence: Synthetic oligonucleotide
  Target: ANGPTL3; (+) strand; PAM type: NRG; PAM sequence: TAG
tttcaaattacctattaagt

SEQ ID NO: 9077 - DNA, 20 bp, Artificial Sequence
  Description of Artificial Sequence: Synthetic oligonucleotide
  Target: ANGPTL3; (+) strand; PAM type: NRG; PAM sequence: TAG
ctcatttctttgatttcatt

SEQ ID NO: 9078 - DNA, 20 bp, Artificial Sequence
  Description of Artificial Sequence: Synthetic oligonucleotide
  Target: ANGPTL3; (+) strand; PAM type: NRG; PAM sequence: TGG
agcattgatctaactcaatg

SEQ ID NO: 9079 - DNA, 20 bp, Artificial Sequence
  Description of Artificial Sequence: Synthetic oligonucleotide
  Target: ANGPTL3; (+) strand; PAM type: NRG; PAM sequence: AAG
attgatctaactcaatgtgg

SEQ ID NO: 9080 - DNA, 20 bp, Artificial Sequence
  Description of Artificial Sequence: Synthetic oligonucleotide
  Target: ANGPTL3; (+) strand; PAM type: NRG; PAM sequence: AAG
gatctaactcaatgtggaag

SEQ ID NO: 9081 - DNA, 20 bp, Artificial Sequence
  Description of Artificial Sequence: Synthetic oligonucleotide
  Target: ANGPTL3; (+) strand; PAM type: NRG; PAM sequence: AGG
atctaactcaatgtggaaga

SEQ ID NO: 9082 - DNA, 20 bp, Artificial Sequence
  Description of Artificial Sequence: Synthetic oligonucleotide
  Target: ANGPTL3; (+) strand; PAM type: NRG; PAM sequence: AAG
gaagaaggttacattcgtgc

SEQ ID NO: 9083 - DNA, 20 bp, Artificial Sequence
  Description of Artificial Sequence: Synthetic oligonucleotide
  Target: ANGPTL3; (+) strand; PAM type: NRG; PAM sequence: CGG
tacattcgtgcaagttaaca

SEQ ID NO: 9084 - DNA, 20 bp, Artificial Sequence
  Description of Artificial Sequence: Synthetic oligonucleotide
  Target: ANGPTL3; (+) strand; PAM type: NRG; PAM sequence: TGG
cctaccaaccttaccttttc

SEQ ID NO: 9085 - DNA, 20 bp, Artificial Sequence
  Description of Artificial Sequence: Synthetic oligonucleotide
  Target: ANGPTL3; (+) strand; PAM type: NRG; PAM sequence: GGG
ctaccaaccttaccttttct

SEQ ID NO: 9086 - DNA, 20 bp, Artificial Sequence
  Description of Artificial Sequence: Synthetic oligonucleotide
  Target: ANGPTL3; (+) strand; PAM type: NRG; PAM sequence: TGG
taccttttctgggcaaatat

SEQ ID NO: 9087 - DNA, 20 bp, Artificial Sequence
  Description of Artificial Sequence: Synthetic oligonucleotide
  Target: ANGPTL3; (+) strand; PAM type: NRG; PAM sequence: TAG
tgggcaaatattggtatata

SEQ ID NO: 9088 - DNA, 20 bp, Artificial Sequence
  Description of Artificial Sequence: Synthetic oligonucleotide
  Target: ANGPTL3; (+) strand; PAM type: NRG; PAM sequence: GAG
ggcaaatattggtatatata

SEQ ID NO: 9089 - DNA, 20 bp, Artificial Sequence
  Description of Artificial Sequence: Synthetic oligonucleotide
  Target: ANGPTL3; (+) strand; PAM type: NRG; PAM sequence: AAG
atattggtatatatagagtt

SEQ ID NO: 9090 - DNA, 20 bp, Artificial Sequence
  Description of Artificial Sequence: Synthetic oligonucleotide
  Target: ANGPTL3; (+) strand; PAM type: NRG; PAM sequence: AAG
ttggtatatatagagttaag

SEQ ID NO: 9091 - DNA, 20 bp, Artificial Sequence
  Description of Artificial Sequence: Synthetic oligonucleotide
  Target: ANGPTL3; (+) strand; PAM type: NRG; PAM sequence: TAG
atatatagagttaagaagtc

SEQ ID NO: 9092 - DNA, 20 bp, Artificial Sequence
  Description of Artificial Sequence: Synthetic oligonucleotide
  Target: ANGPTL3; (+) strand; PAM type: NRG; PAM sequence: AGG
tatatagagttaagaagtct

SEQ ID NO: 9093 - DNA, 20 bp, Artificial Sequence
  Description of Artificial Sequence: Synthetic oligonucleotide
  Target: ANGPTL3; (+) strand; PAM type: NRG; PAM sequence: CAG
aagaagtctaggtctgcttc

SEQ ID NO: 9094 - DNA, 20 bp, Artificial Sequence
  Description of Artificial Sequence: Synthetic oligonucleotide
  Target: ANGPTL3; (+) strand; PAM type: NRG; PAM sequence: AAG
aagtctaggtctgcttccag

SEQ ID NO: 9095 - DNA, 20 bp, Artificial Sequence
  Description of Artificial Sequence: Synthetic oligonucleotide
  Target: ANGPTL3; (+) strand; PAM type: NRG; PAM sequence: CAG
ggtctgcttccagaagaaaa

SEQ ID NO: 9096 - DNA, 20 bp, Artificial Sequence
  Description of Artificial Sequence: Synthetic oligonucleotide
  Target: ANGPTL3; (+) strand; PAM type: NRG; PAM sequence: AAG
gttgcttgaaattgaaaatc

SEQ ID NO: 9097 - DNA, 20 bp, Artificial Sequence
  Description of Artificial Sequence: Synthetic oligonucleotide
  Target: ANGPTL3; (+) strand; PAM type: NRG; PAM sequence: AAG
agataaaaatgttcacaatt

SEQ ID NO: 9098 - DNA, 20 bp, Artificial Sequence
  Description of Artificial Sequence: Synthetic oligonucleotide
  Target: ANGPTL3; (+) strand; PAM type: NRG; PAM sequence: TAG
ccttctttttattgttcctc

SEQ ID NO: 9099 - DNA, 20 bp, Artificial Sequence
  Description of Artificial Sequence: Synthetic oligonucleotide
  Target: ANGPTL3; (+) strand; PAM type: NRG; PAM sequence: CAG
gttcctctagttatttcctc

SEQ ID NO: 9100 - DNA, 20 bp, Artificial Sequence
  Description of Artificial Sequence: Synthetic oligonucleotide
  Target: ANGPTL3; (+) strand; PAM type: NRG; PAM sequence: AAG
tatttcctccagaattgatc

SEQ ID NO: 9101 - DNA, 20 bp, Artificial Sequence
  Description of Artificial Sequence: Synthetic oligonucleotide
  Target: ANGPTL3; (+) strand; PAM type: NRG; PAM sequence: CAG
atcatttgattctctatctc

SEQ ID NO: 9102 - DNA, 20 bp, Artificial Sequence
  Description of Artificial Sequence: Synthetic oligonucleotide
  Target: ANGPTL3; (+) strand; PAM type: NRG; PAM sequence: GAG
catttgattctctatctcca

SEQ ID NO: 9103 - DNA, 20 bp, Artificial Sequence
  Description of Artificial Sequence: Synthetic oligonucleotide
  Target: ANGPTL3; (+) strand; PAM type: NRG; PAM sequence: AAG
ctatctccagagccaaaatc

SEQ ID NO: 9104 - DNA, 20 bp, Artificial Sequence
  Description of Artificial Sequence: Synthetic oligonucleotide
  Target: ANGPTL3; (+) strand; PAM type: NRG; PAM sequence: TAG
aaaatcaagatttgctatgt

SEQ ID NO: 9105 - DNA, 20 bp, Artificial Sequence
  Description of Artificial Sequence: Synthetic oligonucleotide
  Target: ANGPTL3; (+) strand; PAM type: NRG; PAM sequence: TAG
gttagacgatgtaaaaattt

SEQ ID NO: 9106 - DNA, 20 bp, Artificial Sequence
  Description of Artificial Sequence: Synthetic oligonucleotide
  Target: ANGPTL3; (+) strand; PAM type: NRG; PAM sequence: TGG
gatgtaaaaattttagccaa

SEQ ID NO: 9107 - DNA, 20 bp, Artificial Sequence
  Description of Artificial Sequence: Synthetic oligonucleotide
  Target: ANGPTL3; (+) strand; PAM type: NRG; PAM sequence: CAG
ttttagccaatggcctcctt

SEQ ID NO: 9108 - DNA, 20 bp, Artificial Sequence
  Description of Artificial Sequence: Synthetic oligonucleotide
  Target: ANGPTL3; (+) strand; PAM type: NRG; PAM sequence: TGG
agccaatggcctccttcagt

SEQ ID NO: 9109 - DNA, 20 bp, Artificial Sequence
  Description of Artificial Sequence: Synthetic oligonucleotide
  Target: ANGPTL3; (+) strand; PAM type: NRG; PAM sequence: GGG
gccaatggcctccttcagtt

SEQ ID NO: 9110 - DNA, 20 bp, Artificial Sequence
  Description of Artificial Sequence: Synthetic oligonucleotide
  Target: ANGPTL3; (+) strand; PAM type: NRG; PAM sequence: TGG
ggcctccttcagttgggaca

SEQ ID NO: 9111 - DNA, 20 bp, Artificial Sequence
  Description of Artificial Sequence: Synthetic oligonucleotide
  Target: ANGPTL3; (+) strand; PAM type: NRG; PAM sequence: AAG
tcagttgggacatggtctta

SEQ ID NO: 9112 - DNA, 20 bp, Artificial Sequence
  Description of Artificial Sequence: Synthetic oligonucleotide
  Target: ANGPTL3; (+) strand; PAM type: NRG; PAM sequence: AAG
gtcttaaagactttgtccat

SEQ ID NO: 9113 - DNA, 20 bp, Artificial Sequence
  Description of Artificial Sequence: Synthetic oligonucleotide
  Target: ANGPTL3; (+) strand; PAM type: NRG; PAM sequence: AAG
aagactttgtccataagacg

SEQ ID NO: 9114 - DNA, 20 bp, Artificial Sequence
  Description of Artificial Sequence: Synthetic oligonucleotide
  Target: ANGPTL3; (+) strand; PAM type: NRG; PAM sequence: AGG
agactttgtccataagacga

SEQ ID NO: 9115 - DNA, 20 bp, Artificial Sequence
  Description of Artificial Sequence: Synthetic oligonucleotide
  Target: ANGPTL3; (+) strand; PAM type: NRG; PAM sequence: GGG
gactttgtccataagacgaa

SEQ ID NO: 9116 - DNA, 20 bp, Artificial Sequence
  Description of Artificial Sequence: Synthetic oligonucleotide
  Target: ANGPTL3; (+) strand; PAM type: NRG; PAM sequence: CAG
aaaaactcaacatatttgat

SEQ ID NO: 9117 - DNA, 20 bp, Artificial Sequence
  Description of Artificial Sequence: Synthetic oligonucleotide
  Target: ANGPTL3; (+) strand; PAM type: NRG; PAM sequence: CAG
tatgatctatcgctgcaaac

SEQ ID NO: 9118 - DNA, 20 bp, Artificial Sequence
  Description of Artificial Sequence: Synthetic oligonucleotide
  Target: ANGPTL3; (+) strand; PAM type: NRG; PAM sequence: AAG
gctgcaaaccagtgaaatca

SEQ ID NO: 9119 - DNA, 20 bp, Artificial Sequence
  Description of Artificial Sequence: Synthetic oligonucleotide
  Target: ANGPTL3; (+) strand; PAM type: NRG; PAM sequence: AAG
gcaaaccagtgaaatcaaag

SEQ ID NO: 9120 - DNA, 20 bp, Artificial Sequence
  Description of Artificial Sequence: Synthetic oligonucleotide
  Target: ANGPTL3; (+) strand; PAM type: NRG; PAM sequence: AAG
aaccagtgaaatcaaagaag

SEQ ID NO: 9121 - DNA, 20 bp, Artificial Sequence
  Description of Artificial Sequence: Synthetic oligonucleotide
  Target: ANGPTL3; (+) strand; PAM type: NRG; PAM sequence: AAG
gtgaaatcaaagaagaagaa

SEQ ID NO: 9122 - DNA, 20 bp, Artificial Sequence
  Description of Artificial Sequence: Synthetic oligonucleotide
  Target: ANGPTL3; (+) strand; PAM type: NRG; PAM sequence: AGG
tgaaatcaaagaagaagaaa

SEQ ID NO: 9123 - DNA, 20 bp, Artificial Sequence
  Description of Artificial Sequence: Synthetic oligonucleotide
  Target: ANGPTL3; (+) strand; PAM type: NRG; PAM sequence: GAG
aaagaagaagaaaaggaact

SEQ ID NO: 9124 - DNA, 20 bp, Artificial Sequence
  Description of Artificial Sequence: Synthetic oligonucleotide
  Target: ANGPTL3; (+) strand; PAM type: NRG; PAM sequence: AAG
gaagaagaaaaggaactgag

SEQ ID NO: 9125 - DNA, 20 bp, Artificial Sequence
  Description of Artificial Sequence: Synthetic oligonucleotide
  Target: ANGPTL3; (+) strand; PAM type: NRG; PAM sequence: AAG
aagaactacatataaactac

SEQ ID NO: 9126 - DNA, 20 bp, Artificial Sequence
  Description of Artificial Sequence: Synthetic oligonucleotide
  Target: ANGPTL3; (+) strand; PAM type: NRG; PAM sequence: AAG
taaactacaagtcaaaaatg

SEQ ID NO: 9127 - DNA, 20 bp, Artificial Sequence
  Description of Artificial Sequence: Synthetic oligonucleotide
  Target: ANGPTL3; (+) strand; PAM type: NRG; PAM sequence: GAG
aactacaagtcaaaaatgaa

SEQ ID NO: 9128 - DNA, 20 bp, Artificial Sequence
  Description of Artificial Sequence: Synthetic oligonucleotide
  Target: ANGPTL3; (+) strand; PAM type: NRG; PAM sequence: AGG
actacaagtcaaaaatgaag

SEQ ID NO: 9129 - DNA, 20 bp, Artificial Sequence
  Description of Artificial Sequence: Synthetic oligonucleotide
  Target: ANGPTL3; (+) strand; PAM type: NRG; PAM sequence: AAG
aagtcaaaaatgaagaggta

SEQ ID NO: 9130 - DNA, 20 bp, Artificial Sequence
  Description of Artificial Sequence: Synthetic oligonucleotide
  Target: ANGPTL3; (+) strand; PAM type: NRG; PAM sequence: AAG
gaactcaactcaaaacttga

SEQ ID NO: 9131 - DNA, 20 bp, Artificial Sequence
  Description of Artificial Sequence: Synthetic oligonucleotide
  Target: ANGPTL3; (+) strand; PAM type: NRG; PAM sequence: TAG
ctcaaaacttgaaagcctcc

SEQ ID NO: 9132 - DNA, 20 bp, Artificial Sequence
  Description of Artificial Sequence: Synthetic oligonucleotide
  Target: ANGPTL3; (+) strand; PAM type: NRG; PAM sequence: AAG
aaaacttgaaagcctcctag

SEQ ID NO: 9133 - DNA, 20 bp, Artificial Sequence
  Description of Artificial Sequence: Synthetic oligonucleotide
  Target: ANGPTL3; (+) strand; PAM type: NRG; PAM sequence: AAG
aaaaattctacttcaacaaa

SEQ ID NO: 9134 - DNA, 20 bp, Artificial Sequence
  Description of Artificial Sequence: Synthetic oligonucleotide
  Target: ANGPTL3; (+) strand; PAM type: NRG; PAM sequence: TAG
tcaacaaaaagtgaaatatt

SEQ ID NO: 9135 - DNA, 20 bp, Artificial Sequence
  Description of Artificial Sequence: Synthetic oligonucleotide
  Target: ANGPTL3; (+) strand; PAM type: NRG; PAM sequence: AAG
acaaaaagtgaaatatttag

SEQ ID NO: 9136 - DNA, 20 bp, Artificial Sequence
  Description of Artificial Sequence: Synthetic oligonucleotide
  Target: ANGPTL3; (+) strand; PAM type: NRG; PAM sequence: GAG
aaaaagtgaaatatttagaa

SEQ ID NO: 9137 - DNA, 20 bp, Artificial Sequence
  Description of Artificial Sequence: Synthetic oligonucleotide
  Target: ANGPTL3; (+) strand; PAM type: NRG; PAM sequence: CAG
tcaaaatcaacctgaaactc

SEQ ID NO: 9138 - DNA, 20 bp, Artificial Sequence
  Description of Artificial Sequence: Synthetic oligonucleotide
  Target: ANGPTL3; (+) strand; PAM type: NRG; PAM sequence: CAG
acctgaaactccagaacacc

SEQ ID NO: 9139 - DNA, 20 bp, Artificial Sequence
  Description of Artificial Sequence: Synthetic oligonucleotide
  Target: ANGPTL3; (+) strand; PAM type: NRG; PAM sequence: AAG
tgaaactccagaacacccag

SEQ ID NO: 9140 - DNA, 20 bp, Artificial Sequence
  Description of Artificial Sequence: Synthetic oligonucleotide
  Target: ANGPTL3; (+) strand; PAM type: NRG; PAM sequence: AAG
cccagaagtaacttcactta

SEQ ID NO: 9141 - DNA, 20 bp, Artificial Sequence
  Description of Artificial Sequence: Synthetic oligonucleotide
  Target: ANGPTL3; (+) strand; PAM type: NRG; PAM sequence: AAG
gaagtaacttcacttaaagt

SEQ ID NO: 9142 - DNA, 20 bp, Artificial Sequence
  Description of Artificial Sequence: Synthetic oligonucleotide
  Target: ANGPTL3; (+) strand; PAM type: NRG; PAM sequence: TAG
gtaacttcacttaaagtaag

SEQ ID NO: 9143 - DNA, 20 bp, Artificial Sequence
  Description of Artificial Sequence: Synthetic oligonucleotide
  Target: ANGPTL3; (+) strand; PAM type: NRG; PAM sequence: AAG
cttaaagtaagtagaaaata

SEQ ID NO: 9144 - DNA, 20 bp, Artificial Sequence
  Description of Artificial Sequence: Synthetic oligonucleotide
  Target: ANGPTL3; (+) strand; PAM type: NRG; PAM sequence: GAG
taaagtaagtagaaaataaa

SEQ ID NO: 9145 - DNA, 20 bp, Artificial Sequence
  Description of Artificial Sequence: Synthetic oligonucleotide
  Target: ANGPTL3; (+) strand; PAM type: NRG; PAM sequence: AGG
aaagtaagtagaaaataaag

SEQ ID NO: 9146 - DNA, 20 bp, Artificial Sequence
  Description of Artificial Sequence: Synthetic oligonucleotide
  Target: ANGPTL3; (+) strand; PAM type: NRG; PAM sequence: GGG
aagtaagtagaaaataaaga

SEQ ID NO: 9147 - DNA, 20 bp, Artificial Sequence
  Description of Artificial Sequence: Synthetic oligonucleotide
  Target: ANGPTL3; (+) strand; PAM type: NRG; PAM sequence: TGG
tcatgtttatgttttcaatg

SEQ ID NO: 9148 - DNA, 20 bp, Artificial Sequence
  Description of Artificial Sequence: Synthetic oligonucleotide
  Target: ANGPTL3; (+) strand; PAM type: NRG; PAM sequence: AAG
cttttaaaaaaaatatttct

SEQ ID NO: 9149 - DNA, 20 bp, Artificial Sequence
  Description of Artificial Sequence: Synthetic oligonucleotide
  Target: ANGPTL3; (+) strand; PAM type: NRG; PAM sequence: AGG
ttttaaaaaaaatatttcta

SEQ ID NO: 9150 - DNA, 20 bp, Artificial Sequence
  Description of Artificial Sequence: Synthetic oligonucleotide
  Target: ANGPTL3; (+) strand; PAM type: NRG; PAM sequence: AAG
gttgaaatacttttttttcc

SEQ ID NO: 9151 - DNA, 20 bp, Artificial Sequence
  Description of Artificial Sequence: Synthetic oligonucleotide
  Target: ANGPTL3; (+) strand; PAM type: NRG; PAM sequence: CAG
tttccaagaaaaataatctc

SEQ ID NO: 9152 - DNA, 20 bp, Artificial Sequence
  Description of Artificial Sequence: Synthetic oligonucleotide
  Target: ANGPTL3; (+) strand; PAM type: NRG; PAM sequence: AAG
aaatttcctattataatttc

SEQ ID NO: 9153 - DNA, 20 bp, Artificial Sequence
  Description of Artificial Sequence: Synthetic oligonucleotide
  Target: ANGPTL3; (+) strand; PAM type: NRG; PAM sequence: TAG
ttcctattataatttcaagt

SEQ ID NO: 9154 - DNA, 20 bp, Artificial Sequence
  Description of Artificial Sequence: Synthetic oligonucleotide
  Target: ANGPTL3; (+) strand; PAM type: NRG; PAM sequence: CGG
tttatatgaaaattacaaat

SEQ ID NO: 9155 - DNA, 20 bp, Artificial Sequence
  Description of Artificial Sequence: Synthetic oligonucleotide
  Target: ANGPTL3; (+) strand; PAM type: NRG; PAM sequence: TAG
atcggttaaattatacaatc

SEQ ID NO: 9156 - DNA, 20 bp, Artificial Sequence
  Description of Artificial Sequence: Synthetic oligonucleotide
  Target: ANGPTL3; (+) strand; PAM type: NRG; PAM sequence: AAG
tacactattgtaaattactg

SEQ ID NO: 9157 - DNA, 20 bp, Artificial Sequence
  Description of Artificial Sequence: Synthetic oligonucleotide
  Target: ANGPTL3; (+) strand; PAM type: NRG; PAM sequence: AGG
acactattgtaaattactga

SEQ ID NO: 9158 - DNA, 20 bp, Artificial Sequence
  Description of Artificial Sequence: Synthetic oligonucleotide
  Target: ANGPTL3; (+) strand; PAM type: NRG; PAM sequence: AAG
tattgtaaattactgaaggt

SEQ ID NO: 9159 - DNA, 20 bp, Artificial Sequence
  Description of Artificial Sequence: Synthetic oligonucleotide
  Target: ANGPTL3; (+) strand; PAM type: NRG; PAM sequence: AAG
aattactgaaggtaagtaaa

SEQ ID NO: 9160 - DNA, 20 bp, Artificial Sequence
  Description of Artificial Sequence: Synthetic oligonucleotide
  Target: ANGPTL3; (+) strand; PAM type: NRG; PAM sequence: CAG
aaaaatttaaaactattctc

SEQ ID NO: 9161 - DNA, 20 bp, Artificial Sequence
  Description of Artificial Sequence: Synthetic oligonucleotide
  Target: ANGPTL3; (+) strand; PAM type: NRG; PAM sequence: CAG
ctattctccagtgtttaaaa

SEQ ID NO: 9162 - DNA, 20 bp, Artificial Sequence
  Description of Artificial Sequence: Synthetic oligonucleotide
  Target: ANGPTL3; (+) strand; PAM type: NRG; PAM sequence: CAG
ttaaaacagattaaataata

SEQ ID NO: 9163 - DNA, 20 bp, Artificial Sequence
  Description of Artificial Sequence: Synthetic oligonucleotide
  Target: ANGPTL3; (+) strand; PAM type: NRG; PAM sequence: TGG
agattaaataatacagtaaa

SEQ ID NO: 9164 - DNA, 20 bp, Artificial Sequence
  Description of Artificial Sequence: Synthetic oligonucleotide
  Target: ANGPTL3; (+) strand; PAM type: NRG; PAM sequence: AAG
aaataatacagtaaatggaa

SEQ ID NO: 9165 - DNA, 20 bp, Artificial Sequence
  Description of Artificial Sequence: Synthetic oligonucleotide
  Target: ANGPTL3; (+) strand; PAM type: NRG; PAM sequence: TGG
ttattcatatgaaaatatgc

SEQ ID NO: 9166 - DNA, 20 bp, Artificial Sequence
  Description of Artificial Sequence: Synthetic oligonucleotide
  Target: ANGPTL3; (+) strand; PAM type: NRG; PAM sequence: GGG
tattcatatgaaaatatgct

SEQ ID NO: 9167 - DNA, 20 bp, Artificial Sequence
  Description of Artificial Sequence: Synthetic oligonucleotide
  Target: ANGPTL3; (+) strand; PAM type: NRG; PAM sequence: AAG
tgggctttttcttttaattg

SEQ ID NO: 9168 - DNA, 20 bp, Artificial Sequence
  Description of Artificial Sequence: Synthetic oligonucleotide
  Target: ANGPTL3; (+) strand; PAM type: NRG; PAM sequence: CAG
tttttcttttaattgaagtt

SEQ ID NO: 9169 - DNA, 20 bp, Artificial Sequence
  Description of Artificial Sequence: Synthetic oligonucleotide
  Target: ANGPTL3; (+) strand; PAM type: NRG; PAM sequence: TAG
aagttcagaaaatcaaattt

SEQ ID NO: 9170 - DNA, 20 bp, Artificial Sequence
  Description of Artificial Sequence: Synthetic oligonucleotide
  Target: ANGPTL3; (+) strand; PAM type: NRG; PAM sequence: GAG
gttcagaaaatcaaatttta

SEQ ID NO: 9171 - DNA, 20 bp, Artificial Sequence
  Description of Artificial Sequence: Synthetic oligonucleotide
  Target: ANGPTL3; (+) strand; PAM type: NRG; PAM sequence: TAG
agaaaatcaaattttagaga

SEQ ID NO: 9172 - DNA, 20 bp, Artificial Sequence
  Description of Artificial Sequence: Synthetic oligonucleotide
  Target: ANGPTL3; (+) strand; PAM type: NRG; PAM sequence: AAG
tacaatttaaataaaatgtt

SEQ ID NO: 9173 - DNA, 20 bp, Artificial Sequence
  Description of Artificial Sequence: Synthetic oligonucleotide
  Target: ANGPTL3; (+) strand; PAM type: NRG; PAM sequence: AGG
acaatttaaataaaatgtta

SEQ ID NO: 9174 - DNA, 20 bp, Artificial Sequence
  Description of Artificial Sequence: Synthetic oligonucleotide
  Target: ANGPTL3; (+) strand; PAM type: NRG; PAM sequence: AAG
caaaaatatgtgctatttga

SEQ ID NO: 9175 - DNA, 20 bp, Artificial Sequence
  Description of Artificial Sequence: Synthetic oligonucleotide
  Target: ANGPTL3; (+) strand; PAM type: NRG; PAM sequence: AAG
aaatatgtgctatttgaaag

SEQ ID NO: 9176 - DNA, 20 bp, Artificial Sequence
  Description of Artificial Sequence: Synthetic oligonucleotide
  Target: ANGPTL3; (+) strand; PAM type: NRG; PAM sequence: AAG
gctatttgaaagaagcatac

SEQ ID NO: 9177 - DNA, 20 bp, Artificial Sequence
  Description of Artificial Sequence: Synthetic oligonucleotide
  Target: ANGPTL3; (+) strand; PAM type: NRG; PAM sequence: AGG
ctatttgaaagaagcataca

SEQ ID NO: 9178 - DNA, 20 bp, Artificial Sequence
  Description of Artificial Sequence: Synthetic oligonucleotide
  Target: ANGPTL3; (+) strand; PAM type: NRG; PAM sequence: GGG
tatttgaaagaagcatacaa

SEQ ID NO: 9179 - DNA, 20 bp, Artificial Sequence
  Description of Artificial Sequence: Synthetic oligonucleotide
  Target: ANGPTL3; (+) strand; PAM type: NRG; PAM sequence: GGG
atttgaaagaagcatacaag

SEQ ID NO: 9180 - DNA, 20 bp, Artificial Sequence
  Description of Artificial Sequence: Synthetic oligonucleotide
  Target: ANGPTL3; (+) strand; PAM type: NRG; PAM sequence: AAG
tgaaagaagcatacaagggg

SEQ ID NO: 9181 - DNA, 20 bp, Artificial Sequence
  Description of Artificial Sequence: Synthetic oligonucleotide
  Target: ANGPTL3; (+) strand; PAM type: NRG; PAM sequence: AGG
gaaagaagcatacaagggga

SEQ ID NO: 9182 - DNA, 20 bp, Artificial Sequence
  Description of Artificial Sequence: Synthetic oligonucleotide
  Target: ANGPTL3; (+) strand; PAM type: NRG; PAM sequence: TAG
tcatttttcaaatccattat

SEQ ID NO: 9183 - DNA, 20 bp, Artificial Sequence
  Description of Artificial Sequence: Synthetic oligonucleotide
  Target: ANGPTL3; (+) strand; PAM type: NRG; PAM sequence: TAG
ccattattagtttaaaaatt

SEQ ID NO: 9184 - DNA, 20 bp, Artificial Sequence
  Description of Artificial Sequence: Synthetic oligonucleotide
  Target: ANGPTL3; (+) strand; PAM type: NRG; PAM sequence: TAG
tttaaaaatttagattatga

SEQ ID NO: 9185 - DNA, 20 bp, Artificial Sequence
  Description of Artificial Sequence: Synthetic oligonucleotide
  Target: ANGPTL3; (+) strand; PAM type: NRG; PAM sequence: CAG
tttagattatgatagtgtta

SEQ ID NO: 9186 - DNA, 20 bp, Artificial Sequence
  Description of Artificial Sequence: Synthetic oligonucleotide
  Target: ANGPTL3; (+) strand; PAM type: NRG; PAM sequence: AGG
ttagattatgatagtgttac

SEQ ID NO: 9187 - DNA, 20 bp, Artificial Sequence
  Description of Artificial Sequence: Synthetic oligonucleotide
  Target: ANGPTL3; (+) strand; PAM type: NRG; PAM sequence: TAG
atagtgttacaggaaattaa

SEQ ID NO: 9188 - DNA, 20 bp, Artificial Sequence
  Description of Artificial Sequence: Synthetic oligonucleotide
  Target: ANGPTL3; (+) strand; PAM type: NRG; PAM sequence: AAG
gttacaggaaattaatagaa

SEQ ID NO: 9189 - DNA, 20 bp, Artificial Sequence
  Description of Artificial Sequence: Synthetic oligonucleotide
  Target: ANGPTL3; (+) strand; PAM type: NRG; PAM sequence: AAG
caggaaattaatagaaaaga

SEQ ID NO: 9190 - DNA, 20 bp, Artificial Sequence
  Description of Artificial Sequence: Synthetic oligonucleotide
  Target: ANGPTL3; (+) strand; PAM type: NRG; PAM sequence: GAG
ggaaattaatagaaaagaaa

SEQ ID NO: 9191 - DNA, 20 bp, Artificial Sequence
  Description of Artificial Sequence: Synthetic oligonucleotide
  Target: ANGPTL3; (+) strand; PAM type: NRG; PAM sequence: AGG
gaaattaatagaaaagaaag

SEQ ID NO: 9192 - DNA, 20 bp, Artificial Sequence
  Description of Artificial Sequence: Synthetic oligonucleotide
  Target: ANGPTL3; (+) strand; PAM type: NRG; PAM sequence: AAG
ttaatagaaaagaaagagga

SEQ ID NO: 9193 - DNA, 20 bp, Artificial Sequence
  Description of Artificial Sequence: Synthetic oligonucleotide
  Target: ANGPTL3; (+) strand; PAM type: NRG; PAM sequence: CAG
accaacctactctctatatc

SEQ ID NO: 9194 - DNA, 20 bp, Artificial Sequence
  Description of Artificial Sequence: Synthetic oligonucleotide
  Target: ANGPTL3; (+) strand; PAM type: NRG; PAM sequence: TAG
tctctatatccagacttttg

SEQ ID NO: 9195 - DNA, 20 bp, Artificial Sequence
  Description of Artificial Sequence: Synthetic oligonucleotide
  Target: ANGPTL3; (+) strand; PAM type: NRG; PAM sequence: AAG
ccagacttttgtagaaaaac

SEQ ID NO: 9196 - DNA, 20 bp, Artificial Sequence
  Description of Artificial Sequence: Synthetic oligonucleotide
  Target: ANGPTL3; (+) strand; PAM type: NRG; PAM sequence: TAG
tttgtagaaaaacaagataa

SEQ ID NO: 9197 - DNA, 20 bp, Artificial Sequence
  Description of Artificial Sequence: Synthetic oligonucleotide
  Target: ANGPTL3; (+) strand; PAM type: NRG; PAM sequence: AAG
aaaacaagataatagcatca

SEQ ID NO: 9198 - DNA, 20 bp, Artificial Sequence
  Description of Artificial Sequence: Synthetic oligonucleotide
  Target: ANGPTL3; (+) strand; PAM type: NRG; PAM sequence: CAG
atagcatcaaagaccttctc

SEQ ID NO: 9199 - DNA, 20 bp, Artificial Sequence
  Description of Artificial Sequence: Synthetic oligonucleotide
  Target: ANGPTL3; (+) strand; PAM type: NRG; PAM sequence: TGG
caaagaccttctccagaccg

SEQ ID NO: 9200 - DNA, 20 bp, Artificial Sequence
  Description of Artificial Sequence: Synthetic oligonucleotide
  Target: ANGPTL3; (+) strand; PAM type: NRG; PAM sequence: AAG
agaccttctccagaccgtgg

SEQ ID NO: 9201 - DNA, 20 bp, Artificial Sequence
  Description of Artificial Sequence: Synthetic oligonucleotide
  Target: ANGPTL3; (+) strand; PAM type: NRG; PAM sequence: CAG
aatataaacaattaaaccaa

SEQ ID NO: 9202 - DNA, 20 bp, Artificial Sequence
  Description of Artificial Sequence: Synthetic oligonucleotide
  Target: ANGPTL3; (+) strand; PAM type: NRG; PAM sequence: TAG
aaacaattaaaccaacagca

SEQ ID NO: 9203 - DNA, 20 bp, Artificial Sequence
  Description of Artificial Sequence: Synthetic oligonucleotide
  Target: ANGPTL3; (+) strand; PAM type: NRG; PAM sequence: AAG
ccaacagcatagtcaaataa

SEQ ID NO: 9204 - DNA, 20 bp, Artificial Sequence
  Description of Artificial Sequence: Synthetic oligonucleotide
  Target: ANGPTL3; (+) strand; PAM type: NRG; PAM sequence: TAG
gcatagtcaaataaaagaaa

SEQ ID NO: 9205 - DNA, 20 bp, Artificial Sequence
  Description of Artificial Sequence: Synthetic oligonucleotide
  Target: ANGPTL3; (+) strand; PAM type: NRG; PAM sequence: CAG
aaataaaagaaatagaaaat

SEQ ID NO: 9206 - DNA, 20 bp, Artificial Sequence
  Description of Artificial Sequence: Synthetic oligonucleotide
  Target: ANGPTL3; (+) strand; PAM type: NRG; PAM sequence: AGG
aataaaagaaatagaaaatc

SEQ ID NO: 9207 - DNA, 20 bp, Artificial Sequence
  Description of Artificial Sequence: Synthetic oligonucleotide
  Target: ANGPTL3; (+) strand; PAM type: NRG; PAM sequence: AAG
aaagaaatagaaaatcaggt

SEQ ID NO: 9208 - DNA, 20 bp, Artificial Sequence
  Description of Artificial Sequence: Synthetic oligonucleotide
  Target: ANGPTL3; (+) strand; PAM type: NRG; PAM sequence: CAG
aaatagaaaatcaggtaagt

SEQ ID NO: 9209 - DNA, 20 bp, Artificial Sequence
  Description of Artificial Sequence: Synthetic oligonucleotide
  Target: ANGPTL3; (+) strand; PAM type: NRG; PAM sequence: TGG
caggtaagtcagtattttaa

SEQ ID NO: 9210 - DNA, 20 bp, Artificial Sequence
  Description of Artificial Sequence: Synthetic oligonucleotide
  Target: ANGPTL3; (+) strand; PAM type: NRG; PAM sequence: CAG
ggtatgtcccatctttcaca

SEQ ID NO: 9211 - DNA, 20 bp, Artificial Sequence
  Description of Artificial Sequence: Synthetic oligonucleotide
  Target: ANGPTL3; (+) strand; PAM type: NRG; PAM sequence: AGG
gtatgtcccatctttcacac

SEQ ID NO: 9212 - DNA, 20 bp, Artificial Sequence
  Description of Artificial Sequence: Synthetic oligonucleotide
  Target: ANGPTL3; (+) strand; PAM type: NRG; PAM sequence: AAG
tgaatcctaaaattatttac

SEQ ID NO: 9213 - DNA, 20 bp, Artificial Sequence
  Description of Artificial Sequence: Synthetic oligonucleotide
  Target: ANGPTL3; (+) strand; PAM type: NRG; PAM sequence: TGG
aattatttacaagctttaac

SEQ ID NO: 9214 - DNA, 20 bp, Artificial Sequence
  Description of Artificial Sequence: Synthetic oligonucleotide
  Target: ANGPTL3; (+) strand; PAM type: NRG; PAM sequence: GAG
acaagctttaactggatcat

SEQ ID NO: 9215 - DNA, 20 bp, Artificial Sequence
  Description of Artificial Sequence: Synthetic oligonucleotide
  Target: ANGPTL3; (+) strand; PAM type: NRG; PAM sequence: CAG
catgagtaaaattatcacat

SEQ ID NO: 9216 - DNA, 20 bp, Artificial Sequence
  Description of Artificial Sequence: Synthetic oligonucleotide
  Target: ANGPTL3; (+) strand; PAM type: NRG; PAM sequence: CAG
cagcataactgttaaaattg

SEQ ID NO: 9217 - DNA, 20 bp, Artificial Sequence
  Description of Artificial Sequence: Synthetic oligonucleotide
  Target: ANGPTL3; (+) strand; PAM type: NRG; PAM sequence: AGG
agcataactgttaaaattgc

SEQ ID NO: 9218 - DNA, 20 bp, Artificial Sequence
  Description of Artificial Sequence: Synthetic oligonucleotide
  Target: ANGPTL3; (+) strand; PAM type: NRG; PAM sequence: AAG
tgttaaaattgcaggctctg

SEQ ID NO: 9219 - DNA, 20 bp, Artificial Sequence
  Description of Artificial Sequence: Synthetic oligonucleotide
  Target: ANGPTL3; (+) strand; PAM type: NRG; PAM sequence: TGG
aactacctgcatttaaacca

SEQ ID NO: 9220 - DNA, 20 bp, Artificial Sequence
  Description of Artificial Sequence: Synthetic oligonucleotide
  Target: ANGPTL3; (+) strand; PAM type: NRG; PAM sequence: CAG
tacttcacccctttatctct

SEQ ID NO: 9221 - DNA, 20 bp, Artificial Sequence
  Description of Artificial Sequence: Synthetic oligonucleotide
  Target: ANGPTL3; (+) strand; PAM type: NRG; PAM sequence: AAG
gtttcctcacatatactaca

SEQ ID NO: 9222 - DNA, 20 bp, Artificial Sequence
  Description of Artificial Sequence: Synthetic oligonucleotide
  Target: ANGPTL3; (+) strand; PAM type: NRG; PAM sequence: CAG
atatactacaaagataataa

SEQ ID NO: 9223 - DNA, 20 bp, Artificial Sequence
  Description of Artificial Sequence: Synthetic oligonucleotide
  Target: ANGPTL3; (+) strand; PAM type: NRG; PAM sequence: TAG
aaagataataacagaactta

SEQ ID NO: 9224 - DNA, 20 bp, Artificial Sequence
  Description of Artificial Sequence: Synthetic oligonucleotide
  Target: ANGPTL3; (+) strand; PAM type: NRG; PAM sequence: AGG
aagataataacagaacttat

SEQ ID NO: 9225 - DNA, 20 bp, Artificial Sequence
  Description of Artificial Sequence: Synthetic oligonucleotide
  Target: ANGPTL3; (+) strand; PAM type: NRG; PAM sequence: AAG
agaacttataggattattgt

SEQ ID NO: 9226 - DNA, 20 bp, Artificial Sequence
  Description of Artificial Sequence: Synthetic oligonucleotide
  Target: ANGPTL3; (+) strand; PAM type: NRG; PAM sequence: TAG
taagaaaaaaaattaattca

SEQ ID NO: 9227 - DNA, 20 bp, Artificial Sequence
  Description of Artificial Sequence: Synthetic oligonucleotide
  Target: ANGPTL3; (+) strand; PAM type: NRG; PAM sequence: CAG
gaaaaaaaattaattcatag

SEQ ID NO: 9228 - DNA, 20 bp, Artificial Sequence
  Description of Artificial Sequence: Synthetic oligonucleotide
  Target: ANGPTL3; (+) strand; PAM type: NRG; PAM sequence: TAG
catcttactaaaattcaaat

SEQ ID NO: 9229 - DNA, 20 bp, Artificial Sequence
  Description of Artificial Sequence: Synthetic oligonucleotide
  Target: ANGPTL3; (+) strand; PAM type: NRG; PAM sequence: TAG
ctttgctcaaaaccacacaa

SEQ ID NO: 9230 - DNA, 20 bp, Artificial Sequence
  Description of Artificial Sequence: Synthetic oligonucleotide
  Target: ANGPTL3; (+) strand; PAM type: NRG; PAM sequence: TGG
gctttccatttcactcatat

SEQ ID NO: 9231 - DNA, 20 bp, Artificial Sequence
  Description of Artificial Sequence: Synthetic oligonucleotide
  Target: ANGPTL3; (+) strand; PAM type: NRG; PAM sequence: TAG
tttcactcatattggctctt

SEQ ID NO: 9232 - DNA, 20 bp, Artificial Sequence
  Description of Artificial Sequence: Synthetic oligonucleotide
  Target: ANGPTL3; (+) strand; PAM type: NRG; PAM sequence: AAG
tcatattggctctttagacc

SEQ ID NO: 9233 - DNA, 20 bp, Artificial Sequence
  Description of Artificial Sequence: Synthetic oligonucleotide
  Target: ANGPTL3; (+) strand; PAM type: NRG; PAM sequence: TAG
tgacttcacctcctctactc

SEQ ID NO: 9234 - DNA, 20 bp, Artificial Sequence
  Description of Artificial Sequence: Synthetic oligonucleotide
  Target: ANGPTL3; (+) strand; PAM type: NRG; PAM sequence: CAG
agttattctgaccgctttac

SEQ ID NO: 9235 - DNA, 20 bp, Artificial Sequence
  Description of Artificial Sequence: Synthetic oligonucleotide
  Target: ANGPTL3; (+) strand; PAM type: NRG; PAM sequence: AAG
tcaaacatactgccacctca

SEQ ID NO: 9236 - DNA, 20 bp, Artificial Sequence
  Description of Artificial Sequence: Synthetic oligonucleotide
  Target: ANGPTL3; (+) strand; PAM type: NRG; PAM sequence: TGG
cccttgttgtttcctctaac

SEQ ID NO: 9237 - DNA, 20 bp, Artificial Sequence
  Description of Artificial Sequence: Synthetic oligonucleotide
  Target: ANGPTL3; (+) strand; PAM type: NRG; PAM sequence: TGG
actggaacgctcttctgccc

SEQ ID NO: 9238 - DNA, 20 bp, Artificial Sequence
  Description of Artificial Sequence: Synthetic oligonucleotide
  Target: ANGPTL3; (+) strand; PAM type: NRG; PAM sequence: TGG
cttctgccctggtatctacg

SEQ ID NO: 9239 - DNA, 20 bp, Artificial Sequence
  Description of Artificial Sequence: Synthetic oligonucleotide
  Target: ANGPTL3; (+) strand; PAM type: NRG; PAM sequence: TAG
gcccactctctgatttccct

SEQ ID NO: 9240 - DNA, 20 bp, Artificial Sequence
  Description of Artificial Sequence: Synthetic oligonucleotide
  Target: ANGPTL3; (+) strand; PAM type: NRG; PAM sequence: AGG
cccactctctgatttccctt

SEQ ID NO: 9241 - DNA, 20 bp, Artificial Sequence
  Description of Artificial Sequence: Synthetic oligonucleotide
  Target: ANGPTL3; (+) strand; PAM type: NRG; PAM sequence: GGG
ccactctctgatttccctta

SEQ ID NO: 9242 - DNA, 20 bp, Artificial Sequence
  Description of Artificial Sequence: Synthetic oligonucleotide
  Target: ANGPTL3; (+) strand; PAM type: NRG; PAM sequence: AAG
caaacaaaaaattcccaatg

SEQ ID NO: 9243 - DNA, 20 bp, Artificial Sequence
  Description of Artificial Sequence: Synthetic oligonucleotide
  Target: ANGPTL3; (+) strand; PAM type: NRG; PAM sequence: AAG
aattcccaatgaagacttac

SEQ ID NO: 9244 - DNA, 20 bp, Artificial Sequence
  Description of Artificial Sequence: Synthetic oligonucleotide
  Target: ANGPTL3; (+) strand; PAM type: NRG; PAM sequence: AGG
attcccaatgaagacttaca

SEQ ID NO: 9245 - DNA, 20 bp, Artificial Sequence
  Description of Artificial Sequence: Synthetic oligonucleotide
  Target: ANGPTL3; (+) strand; PAM type: NRG; PAM sequence: TGG
aaccaaaaatcacaaccgcc

SEQ ID NO: 9246 - DNA, 20 bp, Artificial Sequence
  Description of Artificial Sequence: Synthetic oligonucleotide
  Target: ANGPTL3; (+) strand; PAM type: NRG; PAM sequence: TAG
cctgaaaacttctacttcct

SEQ ID NO: 9247 - DNA, 20 bp, Artificial Sequence
  Description of Artificial Sequence: Synthetic oligonucleotide
  Target: ANGPTL3; (+) strand; PAM type: NRG; PAM sequence: TAG
atttaacataacataaattt

SEQ ID NO: 9248 - DNA, 20 bp, Artificial Sequence
  Description of Artificial Sequence: Synthetic oligonucleotide
  Target: ANGPTL3; (+) strand; PAM type: NRG; PAM sequence: AAG
ctattcctgcactaaaatgt

SEQ ID NO: 9249 - DNA, 20 bp, Artificial Sequence
  Description of Artificial Sequence: Synthetic oligonucleotide
  Target: ANGPTL3; (+) strand; PAM type: NRG; PAM sequence: CAG
aaatgtaagctctgtgaata

SEQ ID NO: 9250 - DNA, 20 bp, Artificial Sequence
  Description of Artificial Sequence: Synthetic oligonucleotide
  Target: ANGPTL3; (+) strand; PAM type: NRG; PAM sequence: AGG
aatgtaagctctgtgaatac

SEQ ID NO: 9251 - DNA, 20 bp, Artificial Sequence
  Description of Artificial Sequence: Synthetic oligonucleotide
  Target: ANGPTL3; (+) strand; PAM type: NRG; PAM sequence: GGG
atgtaagctctgtgaataca

SEQ ID NO: 9252 - DNA, 20 bp, Artificial Sequence
  Description of Artificial Sequence: Synthetic oligonucleotide
  Target: ANGPTL3; (+) strand; PAM type: NRG; PAM sequence: CAG
tccattatttgtatatactc

SEQ ID NO: 9253 - DNA, 20 bp, Artificial Sequence
  Description of Artificial Sequence: Synthetic oligonucleotide
  Target: ANGPTL3; (+) strand; PAM type: NRG; PAM sequence: TAG
tttgtatatactccagaata

SEQ ID NO: 9254 - DNA, 20 bp, Artificial Sequence
  Description of Artificial Sequence: Synthetic oligonucleotide
  Target: ANGPTL3; (+) strand; PAM type: NRG; PAM sequence: TGG
ccagaatatagaatactgta

SEQ ID NO: 9255 - DNA, 20 bp, Artificial Sequence
  Description of Artificial Sequence: Synthetic oligonucleotide
  Target: ANGPTL3; (+) strand; PAM type: NRG; PAM sequence: CAG
atagaatactgtatggcaca

SEQ ID NO: 9256 - DNA, 20 bp, Artificial Sequence
  Description of Artificial Sequence: Synthetic oligonucleotide
  Target: ANGPTL3; (+) strand; PAM type: NRG; PAM sequence: TAG
gaatactgtatggcacacag

SEQ ID NO: 9257 - DNA, 20 bp, Artificial Sequence
  Description of Artificial Sequence: Synthetic oligonucleotide
  Target: ANGPTL3; (+) strand; PAM type: NRG; PAM sequence: AGG
aatactgtatggcacacagt

SEQ ID NO: 9258 - DNA, 20 bp, Artificial Sequence
  Description of Artificial Sequence: Synthetic oligonucleotide
  Target: ANGPTL3; (+) strand; PAM type: NRG; PAM sequence: CAG
aatgtaatgtcatattcaca

SEQ ID NO: 9259 - DNA, 20 bp, Artificial Sequence
  Description of Artificial Sequence: Synthetic oligonucleotide
  Target: ANGPTL3; (+) strand; PAM type: NRG; PAM sequence: AAG
gtaatgtcatattcacacag

SEQ ID NO: 9260 - DNA, 20 bp, Artificial Sequence
  Description of Artificial Sequence: Synthetic oligonucleotide
  Target: ANGPTL3; (+) strand; PAM type: NRG; PAM sequence: TGG
gtgctatgattattattact

SEQ ID NO: 9261 - DNA, 20 bp, Artificial Sequence
  Description of Artificial Sequence: Synthetic oligonucleotide
  Target: ANGPTL3; (+) strand; PAM type: NRG; PAM sequence: TAG
attattattacttggattac

SEQ ID NO: 9262 - DNA, 20 bp, Artificial Sequence
  Description of Artificial Sequence: Synthetic oligonucleotide
  Target: ANGPTL3; (+) strand; PAM type: NRG; PAM sequence: TAG
attacttggattactagaaa

SEQ ID NO: 9263 - DNA, 20 bp, Artificial Sequence
  Description of Artificial Sequence: Synthetic oligonucleotide
  Target: ANGPTL3; (+) strand; PAM type: NRG; PAM sequence: AAG
aatagtgtgcctcataatta

SEQ ID NO: 9264 - DNA, 20 bp, Artificial Sequence
  Description of Artificial Sequence: Synthetic oligonucleotide
  Target: ANGPTL3; (+) strand; PAM type: NRG; PAM sequence: AGG
atagtgtgcctcataattaa

SEQ ID NO: 9265 - DNA, 20 bp, Artificial Sequence
  Description of Artificial Sequence: Synthetic oligonucleotide
  Target: ANGPTL3; (+) strand; PAM type: NRG; PAM sequence: TGG
taatctacaatgtaaacatc

SEQ ID NO: 9266 - DNA, 20 bp, Artificial Sequence
  Description of Artificial Sequence: Synthetic oligonucleotide
  Target: ANGPTL3; (+) strand; PAM type: NRG; PAM sequence: AAG
tacaatgtaaacatctggtg

SEQ ID NO: 9267 - DNA, 20 bp, Artificial Sequence
  Description of Artificial Sequence: Synthetic oligonucleotide
  Target: ANGPTL3; (+) strand; PAM type: NRG; PAM sequence: CAG
gtaaacatctggtgaagtga

SEQ ID NO: 9268 - DNA, 20 bp, Artificial Sequence
  Description of Artificial Sequence: Synthetic oligonucleotide
  Target: ANGPTL3; (+) strand; PAM type: NRG; PAM sequence: GAG
aaacatctggtgaagtgaca

SEQ ID NO: 9269 - DNA, 20 bp, Artificial Sequence
  Description of Artificial Sequence: Synthetic oligonucleotide
  Target: ANGPTL3; (+) strand; PAM type: NRG; PAM sequence: AGG
aacatctggtgaagtgacag

SEQ ID NO: 9270 - DNA, 20 bp, Artificial Sequence
  Description of Artificial Sequence: Synthetic oligonucleotide
  Target: ANGPTL3; (+) strand; PAM type: NRG; PAM sequence: GGG
acatctggtgaagtgacaga

SEQ ID NO: 9271 - DNA, 20 bp, Artificial Sequence
  Description of Artificial Sequence: Synthetic oligonucleotide
  Target: ANGPTL3; (+) strand; PAM type: NRG; PAM sequence: AAG
tctggtgaagtgacagaggg

SEQ ID NO: 9272 - DNA, 20 bp, Artificial Sequence
  Description of Artificial Sequence: Synthetic oligonucleotide
  Target: ANGPTL3; (+) strand; PAM type: NRG; PAM sequence: TAG
gacagagggaagcacttgtt

SEQ ID NO: 9273 - DNA, 20 bp, Artificial Sequence
  Description of Artificial Sequence: Synthetic oligonucleotide
  Target: ANGPTL3; (+) strand; PAM type: NRG; PAM sequence: AAG
ggaagcacttgtttagaaaa

SEQ ID NO: 9274 - DNA, 20 bp, Artificial Sequence
  Description of Artificial Sequence: Synthetic oligonucleotide
  Target: ANGPTL3; (+) strand; PAM type: NRG; PAM sequence: CAG
tgtttagaaaaaagctatgt

SEQ ID NO: 9275 - DNA, 20 bp, Artificial Sequence
  Description of Artificial Sequence: Synthetic oligonucleotide
  Target: ANGPTL3; (+) strand; PAM type: NRG; PAM sequence: CAG
aatccatgtattctaatatg

SEQ ID NO: 9276 - DNA, 20 bp, Artificial Sequence
  Description of Artificial Sequence: Synthetic oligonucleotide
  Target: ANGPTL3; (+) strand; PAM type: NRG; PAM sequence: TAG
tattctaatatgcagtacaa

SEQ ID NO: 9277 - DNA, 20 bp, Artificial Sequence
  Description of Artificial Sequence: Synthetic oligonucleotide
  Target: ANGPTL3; (+) strand; PAM type: NRG; PAM sequence: CAG
atattaataatactctcaaa

SEQ ID NO: 9278 - DNA, 20 bp, Artificial Sequence
  Description of Artificial Sequence: Synthetic oligonucleotide
  Target: ANGPTL3; (+) strand; PAM type: NRG; PAM sequence: AAG
atactctcaaacagctattc

SEQ ID NO: 9279 - DNA, 20 bp, Artificial Sequence
  Description of Artificial Sequence: Synthetic oligonucleotide
  Target: ANGPTL3; (+) strand; PAM type: NRG; PAM sequence: GAG
actctcaaacagctattcaa

SEQ ID NO: 9280 - DNA, 20 bp, Artificial Sequence
  Description of Artificial Sequence: Synthetic oligonucleotide
  Target: ANGPTL3; (+) strand; PAM type: NRG; PAM sequence: AGG
ctctcaaacagctattcaag

SEQ ID NO: 9281 - DNA, 20 bp, Artificial Sequence
  Description of Artificial Sequence: Synthetic oligonucleotide
  Target: ANGPTL3; (+) strand; PAM type: NRG; PAM sequence: CAG
caaaaaacataatataaact

SEQ ID NO: 9282 - DNA, 20 bp, Artificial Sequence
  Description of Artificial Sequence: Synthetic oligonucleotide
  Target: ANGPTL3; (+) strand; PAM type: NRG; PAM sequence: GAG
aaaaacataatataaactca

SEQ ID NO: 9283 - DNA, 20 bp, Artificial Sequence
  Description of Artificial Sequence: Synthetic oligonucleotide
  Target: ANGPTL3; (+) strand; PAM type: NRG; PAM sequence: TGG
taatataaactcagagaaac

SEQ ID NO: 9284 - DNA, 20 bp, Artificial Sequence
  Description of Artificial Sequence: Synthetic oligonucleotide
  Target: ANGPTL3; (+) strand; PAM type: NRG; PAM sequence: AAG
tggtaaacaaaatcattttc

SEQ ID NO: 9285 - DNA, 20 bp, Artificial Sequence
  Description of Artificial Sequence: Synthetic oligonucleotide
  Target: ANGPTL3; (+) strand; PAM type: NRG; PAM sequence: GAG
gtaaacaaaatcattttcaa

SEQ ID NO: 9286 - DNA, 20 bp, Artificial Sequence
  Description of Artificial Sequence: Synthetic oligonucleotide
  Target: ANGPTL3; (+) strand; PAM type: NRG; PAM sequence: TAG
ccactaaacaaacataatgt

SEQ ID NO: 9287 - DNA, 20 bp, Artificial Sequence
  Description of Artificial Sequence: Synthetic oligonucleotide
  Target: ANGPTL3; (+) strand; PAM type: NRG; PAM sequence: TAG
ctaaacaaacataatgttag

SEQ ID NO: 9288 - DNA, 20 bp, Artificial Sequence
  Description of Artificial Sequence: Synthetic oligonucleotide
  Target: ANGPTL3; (+) strand; PAM type: NRG; PAM sequence: AAG
aatgttagtagtgctgctaa

SEQ ID NO: 9289 - DNA, 20 bp, Artificial Sequence
  Description of Artificial Sequence: Synthetic oligonucleotide
  Target: ANGPTL3; (+) strand; PAM type: NRG; PAM sequence: AGG
atgttagtagtgctgctaaa

SEQ ID NO: 9290 - DNA, 20 bp, Artificial Sequence
  Description of Artificial Sequence: Synthetic oligonucleotide
  Target: ANGPTL3; (+) strand; PAM type: NRG; PAM sequence: TGG
ggttttttatcaactacttt

SEQ ID NO: 9291 - DNA, 20 bp, Artificial Sequence
  Description of Artificial Sequence: Synthetic oligonucleotide
  Target: ANGPTL3; (+) strand; PAM type: NRG; PAM sequence: AAG
ttaaatgaacctgctcccca

SEQ ID NO: 9292 - DNA, 20 bp, Artificial Sequence
  Description of Artificial Sequence: Synthetic oligonucleotide
  Target: ANGPTL3; (+) strand; PAM type: NRG; PAM sequence: TAG
cccaaagcaaaatgttacta

SEQ ID NO: 9293 - DNA, 20 bp, Artificial Sequence
  Description of Artificial Sequence: Synthetic oligonucleotide
  Target: ANGPTL3; (+) strand; PAM type: NRG; PAM sequence: AAG
tctaaaaataaaaatgtgtg

SEQ ID NO: 9294 - DNA, 20 bp, Artificial Sequence
  Description of Artificial Sequence: Synthetic oligonucleotide
  Target: ANGPTL3; (+) strand; PAM type: NRG; PAM sequence: GAG
aaccaaaacaatgaatttct

SEQ ID NO: 9295 - DNA, 20 bp, Artificial Sequence
  Description of Artificial Sequence: Synthetic oligonucleotide
  Target: ANGPTL3; (+) strand; PAM type: NRG; PAM sequence: TGG
aaaacaatgaatttctgagt

SEQ ID NO: 9296 - DNA, 20 bp, Artificial Sequence
  Description of Artificial Sequence: Synthetic oligonucleotide
  Target: ANGPTL3; (+) strand; PAM type: NRG; PAM sequence: AAG
acaatgaatttctgagttgg

SEQ ID NO: 9297 - DNA, 20 bp, Artificial Sequence
  Description of Artificial Sequence: Synthetic oligonucleotide
  Target: ANGPTL3; (+) strand; PAM type: NRG; PAM sequence: AAG
atgaatttctgagttggaag

SEQ ID NO: 9298 - DNA, 20 bp, Artificial Sequence
  Description of Artificial Sequence: Synthetic oligonucleotide
  Target: ANGPTL3; (+) strand; PAM type: NRG; PAM sequence: GAG
gaatttctgagttggaagaa

SEQ ID NO: 9299 - DNA, 20 bp, Artificial Sequence
  Description of Artificial Sequence: Synthetic oligonucleotide
  Target: ANGPTL3; (+) strand; PAM type: NRG; PAM sequence: TAG
ttctgagttggaagaagagt

SEQ ID NO: 9300 - DNA, 20 bp, Artificial Sequence
  Description of Artificial Sequence: Synthetic oligonucleotide
  Target: ANGPTL3; (+) strand; PAM type: NRG; PAM sequence: AAG
aaacaaaactctaaaaattt

SEQ ID NO: 9301 - DNA, 20 bp, Artificial Sequence
  Description of Artificial Sequence: Synthetic oligonucleotide
  Target: ANGPTL3; (+) strand; PAM type: NRG; PAM sequence: AAG
ctaaaaatttaagtaacttt

SEQ ID NO: 9302 - DNA, 20 bp, Artificial Sequence
  Description of Artificial Sequence: Synthetic oligonucleotide
  Target: ANGPTL3; (+) strand; PAM type: NRG; PAM sequence: TAG
taagtaactttaagatcaca

SEQ ID NO: 9303 - DNA, 20 bp, Artificial Sequence
  Description of Artificial Sequence: Synthetic oligonucleotide
  Target: ANGPTL3; (+) strand; PAM type: NRG; PAM sequence: TAG
tttaagatcacatagttact

SEQ ID NO: 9304 - DNA, 20 bp, Artificial Sequence
  Description of Artificial Sequence: Synthetic oligonucleotide
  Target: ANGPTL3; (+) strand; PAM type: NRG; PAM sequence: TAG
aagatcacatagttacttag

SEQ ID NO: 9305 - DNA, 20 bp, Artificial Sequence
  Description of Artificial Sequence: Synthetic oligonucleotide
  Target: ANGPTL3; (+) strand; PAM type: NRG; PAM sequence: AAG
cacatagttacttagtagaa

SEQ ID NO: 9306 - DNA, 20 bp, Artificial Sequence
  Description of Artificial Sequence: Synthetic oligonucleotide
  Target: ANGPTL3; (+) strand; PAM type: NRG; PAM sequence: GAG
catagttacttagtagaaaa

SEQ ID NO: 9307 - DNA, 20 bp, Artificial Sequence
  Description of Artificial Sequence: Synthetic oligonucleotide
  Target: ANGPTL3; (+) strand; PAM type: NRG; PAM sequence: CAG
tagtagaaaagagtaatacc

SEQ ID NO: 9308 - DNA, 20 bp, Artificial Sequence
  Description of Artificial Sequence: Synthetic oligonucleotide
  Target: ANGPTL3; (+) strand; PAM type: NRG; PAM sequence: AAG
agaaaagagtaatacccagc

SEQ ID NO: 9309 - DNA, 20 bp, Artificial Sequence
  Description of Artificial Sequence: Synthetic oligonucleotide
  Target: ANGPTL3; (+) strand; PAM type: NRG; PAM sequence: TAG
ccagcaagcaaactttacaa

SEQ ID NO: 9310 - DNA, 20 bp, Artificial Sequence
  Description of Artificial Sequence: Synthetic oligonucleotide
  Target: ANGPTL3; (+) strand; PAM type: NRG; PAM sequence: AAG
tacaatagatccttttaaat

SEQ ID NO: 9311 - DNA, 20 bp, Artificial Sequence
  Description of Artificial Sequence: Synthetic oligonucleotide
  Target: ANGPTL3; (+) strand; PAM type: NRG; PAM sequence: AGG
acaatagatccttttaaata

SEQ ID NO: 9312 - DNA, 20 bp, Artificial Sequence
  Description of Artificial Sequence: Synthetic oligonucleotide
  Target: ANGPTL3; (+) strand; PAM type: NRG; PAM sequence: TAG
gatccttttaaataaggtcc

SEQ ID NO: 9313 - DNA, 20 bp, Artificial Sequence
  Description of Artificial Sequence: Synthetic oligonucleotide
  Target: ANGPTL3; (+) strand; PAM type: NRG; PAM sequence: AGG
atccttttaaataaggtcct

SEQ ID NO: 9314 - DNA, 20 bp, Artificial Sequence
  Description of Artificial Sequence: Synthetic oligonucleotide
  Target: ANGPTL3; (+) strand; PAM type: NRG; PAM sequence: CAG
ctaggaaatatcattcatgc

SEQ ID NO: 9315 - DNA, 20 bp, Artificial Sequence
  Description of Artificial Sequence: Synthetic oligonucleotide
  Target: ANGPTL3; (+) strand; PAM type: NRG; PAM sequence: AAG
aaaactaacactaataatgc

SEQ ID NO: 9316 - DNA, 20 bp, Artificial Sequence
  Description of Artificial Sequence: Synthetic oligonucleotide
  Target: ANGPTL3; (+) strand; PAM type: NRG; PAM sequence: GAG
ctgcttttcttactgtcaat

SEQ ID NO: 9317 - DNA, 20 bp, Artificial Sequence
  Description of Artificial Sequence: Synthetic oligonucleotide
  Target: ANGPTL3; (+) strand; PAM type: NRG; PAM sequence: TAG
acgataaactactgaatata

SEQ ID NO: 9318 - DNA, 20 bp, Artificial Sequence
  Description of Artificial Sequence: Synthetic oligonucleotide
  Target: ANGPTL3; (+) strand; PAM type: NRG; PAM sequence: AAG
taaactactgaatatataga

SEQ ID NO: 9319 - DNA, 20 bp, Artificial Sequence
  Description of Artificial Sequence: Synthetic oligonucleotide
  Target: ANGPTL3; (+) strand; PAM type: NRG; PAM sequence: AAG
ctactgaatatatagaaagt

SEQ ID NO: 9320 - DNA, 20 bp, Artificial Sequence
  Description of Artificial Sequence: Synthetic oligonucleotide
  Target: ANGPTL3; (+) strand; PAM type: NRG; PAM sequence: CAG
tgccaacctgccaacatcta

SEQ ID NO: 9321 - DNA, 20 bp, Artificial Sequence
  Description of Artificial Sequence: Synthetic oligonucleotide
  Target: ANGPTL3; (+) strand; PAM type: NRG; PAM sequence: CAG
aacatctacagatatgttta

SEQ ID NO: 9322 - DNA, 20 bp, Artificial Sequence
  Description of Artificial Sequence: Synthetic oligonucleotide
  Target: ANGPTL3; (+) strand; PAM type: NRG; PAM sequence: AGG
acatctacagatatgtttac

SEQ ID NO: 9323 - DNA, 20 bp, Artificial Sequence
  Description of Artificial Sequence: Synthetic oligonucleotide
  Target: ANGPTL3; (+) strand; PAM type: NRG; PAM sequence: AAG
tcaaaaattatcaaattatc

SEQ ID NO: 9324 - DNA, 20 bp, Artificial Sequence
  Description of Artificial Sequence: Synthetic oligonucleotide
  Target: ANGPTL3; (+) strand; PAM type: NRG; PAM sequence: AAG
aaattatcaaattatcaaga

SEQ ID NO: 9325 - DNA, 20 bp, Artificial Sequence
  Description of Artificial Sequence: Synthetic oligonucleotide
  Target: ANGPTL3; (+) strand; PAM type: NRG; PAM sequence: TGG
atcaaattatcaagaaagcc

SEQ ID NO: 9326 - DNA, 20 bp, Artificial Sequence
  Description of Artificial Sequence: Synthetic oligonucleotide
  Target: ANGPTL3; (+) strand; PAM type: NRG; PAM sequence: CAG
tatgtattatgtctttatca

SEQ ID NO: 9327 - DNA, 20 bp, Artificial Sequence
  Description of Artificial Sequence: Synthetic oligonucleotide
  Target: ANGPTL3; (+) strand; PAM type: NRG; PAM sequence: AGG
atgtattatgtctttatcac

SEQ ID NO: 9328 - DNA, 20 bp, Artificial Sequence
  Description of Artificial Sequence: Synthetic oligonucleotide
  Target: ANGPTL3; (+) strand; PAM type: NRG; PAM sequence: AAG
atgtctttatcacaggtctg

SEQ ID NO: 9329 - DNA, 20 bp, Artificial Sequence
  Description of Artificial Sequence: Synthetic oligonucleotide
  Target: ANGPTL3; (+) strand; PAM type: NRG; PAM sequence: CAG
tttatcacaggtctgaagat

SEQ ID NO: 9330 - DNA, 20 bp, Artificial Sequence
  Description of Artificial Sequence: Synthetic oligonucleotide
  Target: ANGPTL3; (+) strand; PAM type: NRG; PAM sequence: AAG
tcacaggtctgaagatcagt

SEQ ID NO: 9331 - DNA, 20 bp, Artificial Sequence
  Description of Artificial Sequence: Synthetic oligonucleotide
  Target: ANGPTL3; (+) strand; PAM type: NRG; PAM sequence: CAG
tattaaacttaaaatctgaa

SEQ ID NO: 9332 - DNA, 20 bp, Artificial Sequence
  Description of Artificial Sequence: Synthetic oligonucleotide
  Target: ANGPTL3; (+) strand; PAM type: NRG; PAM sequence: AAG
tattttattcatataaataa

SEQ ID NO: 9333 - DNA, 20 bp, Artificial Sequence
  Description of Artificial Sequence: Synthetic oligonucleotide
  Target: ANGPTL3; (+) strand; PAM type: NRG; PAM sequence: AAG
agaatacattacaatattct

SEQ ID NO: 9334 - DNA, 20 bp, Artificial Sequence
  Description of Artificial Sequence: Synthetic oligonucleotide
  Target: ANGPTL3; (+) strand; PAM type: NRG; PAM sequence: AAG
acattacaatattctaagca

SEQ ID NO: 9335 - DNA, 20 bp, Artificial Sequence
  Description of Artificial Sequence: Synthetic oligonucleotide
  Target: ANGPTL3; (+) strand; PAM type: NRG; PAM sequence: CAG
ttacaatattctaagcaaag

SEQ ID NO: 9336 - DNA, 20 bp, Artificial Sequence
  Description of Artificial Sequence: Synthetic oligonucleotide
  Target: ANGPTL3; (+) strand; PAM type: NRG; PAM sequence: TGG
agcaaagcagtctctacttt

SEQ ID NO: 9337 - DNA, 20 bp, Artificial Sequence
  Description of Artificial Sequence: Synthetic oligonucleotide
  Target: ANGPTL3; (+) strand; PAM type: NRG; PAM sequence: GAG
tgtccctgattaaatatttt

SEQ ID NO: 9338 - DNA, 20 bp, Artificial Sequence
  Description of Artificial Sequence: Synthetic oligonucleotide
  Target: ANGPTL3; (+) strand; PAM type: NRG; PAM sequence: CAG
ctgattaaatattttgagaa

SEQ ID NO: 9339 - DNA, 20 bp, Artificial Sequence
  Description of Artificial Sequence: Synthetic oligonucleotide
  Target: ANGPTL3; (+) strand; PAM type: NRG; PAM sequence: AGG
tgattaaatattttgagaac

SEQ ID NO: 9340 - DNA, 20 bp, Artificial Sequence
  Description of Artificial Sequence: Synthetic oligonucleotide
  Target: ANGPTL3; (+) strand; PAM type: NRG; PAM sequence: AAG
gttataacattatgaactga

SEQ ID NO: 9341 - DNA, 20 bp, Artificial Sequence
  Description of Artificial Sequence: Synthetic oligonucleotide
  Target: ANGPTL3; (+) strand; PAM type: NRG; PAM sequence: CAG
gtacttctgacatccttact

SEQ ID NO: 9342 - DNA, 20 bp, Artificial Sequence
  Description of Artificial Sequence: Synthetic oligonucleotide
  Target: ANGPTL3; (+) strand; PAM type: NRG; PAM sequence: CAG
atttcccctaattgtatatt

SEQ ID NO: 9343 - DNA, 20 bp, Artificial Sequence
  Description of Artificial Sequence: Synthetic oligonucleotide
  Target: ANGPTL3; (+) strand; PAM type: NRG; PAM sequence: CAG
ttcagtatcattttaaaaaa

SEQ ID NO: 9344 - DNA, 20 bp, Artificial Sequence
  Description of Artificial Sequence: Synthetic oligonucleotide
  Target: ANGPTL3; (+) strand; PAM type: NRG; PAM sequence: CAG
acagatttatattcttttat

SEQ ID NO: 9345 - DNA, 20 bp, Artificial Sequence
  Description of Artificial Sequence: Synthetic oligonucleotide
  Target: ANGPTL3; (+) strand; PAM type: NRG; PAM sequence: CAG
tttatattcttttatcagct

SEQ ID NO: 9346 - DNA, 20 bp, Artificial Sequence
  Description of Artificial Sequence: Synthetic oligonucleotide
  Target: ANGPTL3; (+) strand; PAM type: NRG; PAM sequence: AAG
atattcttttatcagctcag

SEQ ID NO: 9347 - DNA, 20 bp, Artificial Sequence
  Description of Artificial Sequence: Synthetic oligonucleotide
  Target: ANGPTL3; (+) strand; PAM type: NRG; PAM sequence: AGG
tattcttttatcagctcaga

SEQ ID NO: 9348 - DNA, 20 bp, Artificial Sequence
  Description of Artificial Sequence: Synthetic oligonucleotide
  Target: ANGPTL3; (+) strand; PAM type: NRG; PAM sequence: TAG
ttttatcagctcagaaggac

SEQ ID NO: 9349 - DNA, 20 bp, Artificial Sequence
  Description of Artificial Sequence: Synthetic oligonucleotide
  Target: ANGPTL3; (+) strand; PAM type: NRG; PAM sequence: AAG
gctcagaaggactagtattc

SEQ ID NO: 9350 - DNA, 20 bp, Artificial Sequence
  Description of Artificial Sequence: Synthetic oligonucleotide
  Target: ANGPTL3; (+) strand; PAM type: NRG; PAM sequence: CAG
gactagtattcaagaaccca

SEQ ID NO: 9351 - DNA, 20 bp, Artificial Sequence
  Description of Artificial Sequence: Synthetic oligonucleotide
  Target: ANGPTL3; (+) strand; PAM type: NRG; PAM sequence: AAG
cagaaatttctctatcttcc

SEQ ID NO: 9352 - DNA, 20 bp, Artificial Sequence
  Description of Artificial Sequence: Synthetic oligonucleotide
  Target: ANGPTL3; (+) strand; PAM type: NRG; PAM sequence: AAG
atttctctatcttccaagcc

SEQ ID NO: 9353 - DNA, 20 bp, Artificial Sequence
  Description of Artificial Sequence: Synthetic oligonucleotide
  Target: ANGPTL3; (+) strand; PAM type: NRG; PAM sequence: GAG
ttctctatcttccaagccaa

SEQ ID NO: 9354 - DNA, 20 bp, Artificial Sequence
  Description of Artificial Sequence: Synthetic oligonucleotide
  Target: ANGPTL3; (+) strand; PAM type: NRG; PAM sequence: AAG
tcttccaagccaagagcacc

SEQ ID NO: 9355 - DNA, 20 bp, Artificial Sequence
  Description of Artificial Sequence: Synthetic oligonucleotide
  Target: ANGPTL3; (+) strand; PAM type: NRG; PAM sequence: CAG
caagaactactccctttctt

SEQ ID NO: 9356 - DNA, 20 bp, Artificial Sequence
  Description of Artificial Sequence: Synthetic oligonucleotide
  Target: ANGPTL3; (+) strand; PAM type: NRG; PAM sequence: AAG
tttcttcagttgaatgaaat

SEQ ID NO: 9357 - DNA, 20 bp, Artificial Sequence
  Description of Artificial Sequence: Synthetic oligonucleotide
  Target: ANGPTL3; (+) strand; PAM type: NRG; PAM sequence: TGG
ataagaaatgtaaaacatga

SEQ ID NO: 9358 - DNA, 20 bp, Artificial Sequence
  Description of Artificial Sequence: Synthetic oligonucleotide
  Target: ANGPTL3; (+) strand; PAM type: NRG; PAM sequence: AAG
gaaatgtaaaacatgatggt

SEQ ID NO: 9359 - DNA, 20 bp, Artificial Sequence
  Description of Artificial Sequence: Synthetic oligonucleotide
  Target: ANGPTL3; (+) strand; PAM type: NRG; PAM sequence: TGG
aacatgatggtaagacactt

SEQ ID NO: 9360 - DNA, 20 bp, Artificial Sequence
  Description of Artificial Sequence: Synthetic oligonucleotide
  Target: ANGPTL3; (+) strand; PAM type: NRG; PAM sequence: TGG
atgatggtaagacactttgg

SEQ ID NO: 9361 - DNA, 20 bp, Artificial Sequence
  Description of Artificial Sequence: Synthetic oligonucleotide
  Target: ANGPTL3; (+) strand; PAM type: NRG; PAM sequence: GGG
tgatggtaagacactttggt

SEQ ID NO: 9362 - DNA, 20 bp, Artificial Sequence
  Description of Artificial Sequence: Synthetic oligonucleotide
  Target: ANGPTL3; (+) strand; PAM type: NRG; PAM sequence: AAG
tttggtgggtttccttcttg

SEQ ID NO: 9363 - DNA, 20 bp, Artificial Sequence
  Description of Artificial Sequence: Synthetic oligonucleotide
  Target: ANGPTL3; (+) strand; PAM type: NRG; PAM sequence: TAG
attatcaaattccctattct

SEQ ID NO: 9364 - DNA, 20 bp, Artificial Sequence
  Description of Artificial Sequence: Synthetic oligonucleotide
  Target: ANGPTL3; (+) strand; PAM type: NRG; PAM sequence: AGG
ttatcaaattccctattctt

SEQ ID NO: 9365 - DNA, 20 bp, Artificial Sequence
  Description of Artificial Sequence: Synthetic oligonucleotide
  Target: ANGPTL3; (+) strand; PAM type: NRG; PAM sequence: TAG
cctattcttaggacttgttc

SEQ ID NO: 9366 - DNA, 20 bp, Artificial Sequence
  Description of Artificial Sequence: Synthetic oligonucleotide
  Target: ANGPTL3; (+) strand; PAM type: NRG; PAM sequence: AAG
taggacttgttctagactaa

SEQ ID NO: 9367 - DNA, 20 bp, Artificial Sequence
  Description of Artificial Sequence: Synthetic oligonucleotide
  Target: ANGPTL3; (+) strand; PAM type: NRG; PAM sequence: TAG
acttgttctagactaaaaga

SEQ ID NO: 9368 - DNA, 20 bp, Artificial Sequence
  Description of Artificial Sequence: Synthetic oligonucleotide
  Target: ANGPTL3; (+) strand; PAM type: NRG; PAM sequence: AAG
ttctagactaaaagatagtt

SEQ ID NO: 9369 - DNA, 20 bp, Artificial Sequence
  Description of Artificial Sequence: Synthetic oligonucleotide
  Target: ANGPTL3; (+) strand; PAM type: NRG; PAM sequence: GAG
ctagactaaaagatagttaa

SEQ ID NO: 9370 - DNA, 20 bp, Artificial Sequence
  Description of Artificial Sequence: Synthetic oligonucleotide
  Target: ANGPTL3; (+) strand; PAM type: NRG; PAM sequence: TGG
tacaatgtatcaacctaaac

SEQ ID NO: 9371 - DNA, 20 bp, Artificial Sequence
  Description of Artificial Sequence: Synthetic oligonucleotide
  Target: ANGPTL3; (+) strand; PAM type: NRG; PAM sequence: TGG
tatcaacctaaactggatgc

SEQ ID NO: 9372 - DNA, 20 bp, Artificial Sequence
  Description of Artificial Sequence: Synthetic oligonucleotide
  Target: ANGPTL3; (+) strand; PAM type: NRG; PAM sequence: GGG
atcaacctaaactggatgct

SEQ ID NO: 9373 - DNA, 20 bp, Artificial Sequence
  Description of Artificial Sequence: Synthetic oligonucleotide
  Target: ANGPTL3; (+) strand; PAM type: NRG; PAM sequence: GGG
tcaacctaaactggatgctg

SEQ ID NO: 9374 - DNA, 20 bp, Artificial Sequence
  Description of Artificial Sequence: Synthetic oligonucleotide
  Target: ANGPTL3; (+) strand; PAM type: NRG; PAM sequence: AAG
gttctttttacaccctataa

SEQ ID NO: 9375 - DNA, 20 bp, Artificial Sequence
  Description of Artificial Sequence: Synthetic oligonucleotide
  Target: ANGPTL3; (+) strand; PAM type: NRG; PAM sequence: AAG
accctataaaagacatacct

SEQ ID NO: 9376 - DNA, 20 bp, Artificial Sequence
  Description of Artificial Sequence: Synthetic oligonucleotide
  Target: ANGPTL3; (+) strand; PAM type: NRG; PAM sequence: CAG
aaagacatacctaagacaat

SEQ ID NO: 9377 - DNA, 20 bp, Artificial Sequence
  Description of Artificial Sequence: Synthetic oligonucleotide
  Target: ANGPTL3; (+) strand; PAM type: NRG; PAM sequence: GAG
agacatacctaagacaatca

SEQ ID NO: 9378 - DNA, 20 bp, Artificial Sequence
  Description of Artificial Sequence: Synthetic oligonucleotide
  Target: ANGPTL3; (+) strand; PAM type: NRG; PAM sequence: TGG
caatcagagaaatacaaata

SEQ ID NO: 9379 - DNA, 20 bp, Artificial Sequence
  Description of Artificial Sequence: Synthetic oligonucleotide
  Target: ANGPTL3; (+) strand; PAM type: NRG; PAM sequence: TAG
acaaatatggacttgattat

SEQ ID NO: 9380 - DNA, 20 bp, Artificial Sequence
  Description of Artificial Sequence: Synthetic oligonucleotide
  Target: ANGPTL3; (+) strand; PAM type: NRG; PAM sequence: TAG
gacttgattattagataata

SEQ ID NO: 9381 - DNA, 20 bp, Artificial Sequence
  Description of Artificial Sequence: Synthetic oligonucleotide
  Target: ANGPTL3; (+) strand; PAM type: NRG; PAM sequence: AAG
ttgattattagataatatag

SEQ ID NO: 9382 - DNA, 20 bp, Artificial Sequence
  Description of Artificial Sequence: Synthetic oligonucleotide
  Target: ANGPTL3; (+) strand; PAM type: NRG; PAM sequence: AGG
tgattattagataatataga

SEQ ID NO: 9383 - DNA, 20 bp, Artificial Sequence
  Description of Artificial Sequence: Synthetic oligonucleotide
  Target: ANGPTL3; (+) strand; PAM type: NRG; PAM sequence: TAG
agaaggtttattaattttct

SEQ ID NO: 9384 - DNA, 20 bp, Artificial Sequence
  Description of Artificial Sequence: Synthetic oligonucleotide
  Target: ANGPTL3; (+) strand; PAM type: NRG; PAM sequence: TGG
aattttcttagatgtgatca

SEQ ID NO: 9385 - DNA, 20 bp, Artificial Sequence
  Description of Artificial Sequence: Synthetic oligonucleotide
  Target: ANGPTL3; (+) strand; PAM type: NRG; PAM sequence: CAG
tagatgtgatcatggtattg

SEQ ID NO: 9386 - DNA, 20 bp, Artificial Sequence
  Description of Artificial Sequence: Synthetic oligonucleotide
  Target: ANGPTL3; (+) strand; PAM type: NRG; PAM sequence: AAG
atcatggtattgcagtttta

SEQ ID NO: 9387 - DNA, 20 bp, Artificial Sequence
  Description of Artificial Sequence: Synthetic oligonucleotide
  Target: ANGPTL3; (+) strand; PAM type: NRG; PAM sequence: AGG
tcatggtattgcagttttaa

SEQ ID NO: 9388 - DNA, 20 bp, Artificial Sequence
  Description of Artificial Sequence: Synthetic oligonucleotide
  Target: ANGPTL3; (+) strand; PAM type: NRG; PAM sequence: GAG
atggtattgcagttttaaag

SEQ ID NO: 9389 - DNA, 20 bp, Artificial Sequence
  Description of Artificial Sequence: Synthetic oligonucleotide
  Target: ANGPTL3; (+) strand; PAM type: NRG; PAM sequence: AAG
aggagaacaatctcctgttt

SEQ ID NO: 9390 - DNA, 20 bp, Artificial Sequence
  Description of Artificial Sequence: Synthetic oligonucleotide
  Target: ANGPTL3; (+) strand; PAM type: NRG; PAM sequence: GAG
gagaacaatctcctgtttaa

SEQ ID NO: 9391 - DNA, 20 bp, Artificial Sequence
  Description of Artificial Sequence: Synthetic oligonucleotide
  Target: ANGPTL3; (+) strand; PAM type: NRG; PAM sequence: CGG
gatacatgctgaaatattta

SEQ ID NO: 9392 - DNA, 20 bp, Artificial Sequence
  Description of Artificial Sequence: Synthetic oligonucleotide
  Target: ANGPTL3; (+) strand; PAM type: NRG; PAM sequence: GAG
tacatgctgaaatatttacg

SEQ ID NO: 9393 - DNA, 20 bp, Artificial Sequence
  Description of Artificial Sequence: Synthetic oligonucleotide
  Target: ANGPTL3; (+) strand; PAM type: NRG; PAM sequence: AAG
ctgaaatatttacggagtta

SEQ ID NO: 9394 - DNA, 20 bp, Artificial Sequence
  Description of Artificial Sequence: Synthetic oligonucleotide
  Target: ANGPTL3; (+) strand; PAM type: NRG; PAM sequence: AGG
tgaaatatttacggagttaa

SEQ ID NO: 9395 - DNA, 20 bp, Artificial Sequence
  Description of Artificial Sequence: Synthetic oligonucleotide
  Target: ANGPTL3; (+) strand; PAM type: NRG; PAM sequence: TGG
tttacggagttaaaggtcac

SEQ ID NO: 9396 - DNA, 20 bp, Artificial Sequence
  Description of Artificial Sequence: Synthetic oligonucleotide
  Target: ANGPTL3; (+) strand; PAM type: NRG; PAM sequence: CAG
agttaaaggtcactggactc

SEQ ID NO: 9397 - DNA, 20 bp, Artificial Sequence
  Description of Artificial Sequence: Synthetic oligonucleotide
  Target: ANGPTL3; (+) strand; PAM type: NRG; PAM sequence: TGG
aaggtcactggactccagac

SEQ ID NO: 9398 - DNA, 20 bp, Artificial Sequence
  Description of Artificial Sequence: Synthetic oligonucleotide
  Target: ANGPTL3; (+) strand; PAM type: NRG; PAM sequence: TAG
actggactccagactggtga

SEQ ID NO: 9399 - DNA, 20 bp, Artificial Sequence
  Description of Artificial Sequence: Synthetic oligonucleotide
  Target: ANGPTL3; (+) strand; PAM type: NRG; PAM sequence: AAG
ctccagactggtgatagaac

SEQ ID NO: 9400 - DNA, 20 bp, Artificial Sequence
  Description of Artificial Sequence: Synthetic oligonucleotide
  Target: ANGPTL3; (+) strand; PAM type: NRG; PAM sequence: AAG
aaaaataattaattttttaa

SEQ ID NO: 9401 - DNA, 20 bp, Artificial Sequence
  Description of Artificial Sequence: Synthetic oligonucleotide
  Target: ANGPTL3; (+) strand; PAM type: NRG; PAM sequence: TAG
attaattttttaaaagaaaa

SEQ ID NO: 9402 - DNA, 20 bp, Artificial Sequence
  Description of Artificial Sequence: Synthetic oligonucleotide
  Target: ANGPTL3; (+) strand; PAM type: NRG; PAM sequence: TGG
ttttttaaaagaaaatagtt

SEQ ID NO: 9403 - DNA, 20 bp, Artificial Sequence
  Description of Artificial Sequence: Synthetic oligonucleotide
  Target: ANGPTL3; (+) strand; PAM type: NRG; PAM sequence: AAG
ttaaaagaaaatagtttggt

SEQ ID NO: 9404 - DNA, 20 bp, Artificial Sequence
  Description of Artificial Sequence: Synthetic oligonucleotide
  Target: ANGPTL3; (+) strand; PAM type: NRG; PAM sequence: AAG
tcttaaataacacgccatct

SEQ ID NO: 9405 - DNA, 20 bp, Artificial Sequence
  Description of Artificial Sequence: Synthetic oligonucleotide
  Target: ANGPTL3; (+) strand; PAM type: NRG; PAM sequence: AAG
ccacaacttcataaaatgtc

SEQ ID NO: 9406 - DNA, 20 bp, Artificial Sequence
  Description of Artificial Sequence: Synthetic oligonucleotide
  Target: ANGPTL3; (+) strand; PAM type: NRG; PAM sequence: AAG
aaaatgtcaagtgaaatctc

SEQ ID NO: 9407 - DNA, 20 bp, Artificial Sequence
  Description of Artificial Sequence: Synthetic oligonucleotide
  Target: ANGPTL3; (+) strand; PAM type: NRG; PAM sequence: AAG
aagtgaaatctcaagctcca

SEQ ID NO: 9408 - DNA, 20 bp, Artificial Sequence
  Description of Artificial Sequence: Synthetic oligonucleotide
  Target: ANGPTL3; (+) strand; PAM type: NRG; PAM sequence: TAG
taataacattttattgattc

SEQ ID NO: 9409 - DNA, 20 bp, Artificial Sequence
  Description of Artificial Sequence: Synthetic oligonucleotide
  Target: ANGPTL3; (+) strand; PAM type: NRG; PAM sequence: AGG
aataacattttattgattct

SEQ ID NO: 9410 - DNA, 20 bp, Artificial Sequence
  Description of Artificial Sequence: Synthetic oligonucleotide
  Target: ANGPTL3; (+) strand; PAM type: NRG; PAM sequence: CAG
gaatgtaccaccatttataa

SEQ ID NO: 9411 - DNA, 20 bp, Artificial Sequence
  Description of Artificial Sequence: Synthetic oligonucleotide
  Target: ANGPTL3; (+) strand; PAM type: NRG; PAM sequence: GAG
atgtaccaccatttataaca

SEQ ID NO: 9412 - DNA, 20 bp, Artificial Sequence
  Description of Artificial Sequence: Synthetic oligonucleotide
  Target: ANGPTL3; (+) strand; PAM type: NRG; PAM sequence: AGG
tgtaccaccatttataacag

SEQ ID NO: 9413 - DNA, 20 bp, Artificial Sequence
  Description of Artificial Sequence: Synthetic oligonucleotide
  Target: ANGPTL3; (+) strand; PAM type: NRG; PAM sequence: AAG
tataacagaggtgaacatac

SEQ ID NO: 9414 - DNA, 20 bp, Artificial Sequence
  Description of Artificial Sequence: Synthetic oligonucleotide
  Target: ANGPTL3; (+) strand; PAM type: NRG; PAM sequence: TGG
aacagaggtgaacatacaag

SEQ ID NO: 9415 - DNA, 20 bp, Artificial Sequence
  Description of Artificial Sequence: Synthetic oligonucleotide
  Target: ANGPTL3; (+) strand; PAM type: NRG; PAM sequence: CAG
acaagtggcatgtatgccat

SEQ ID NO: 9416 - DNA, 20 bp, Artificial Sequence
  Description of Artificial Sequence: Synthetic oligonucleotide
  Target: ANGPTL3; (+) strand; PAM type: NRG; PAM sequence: CAG
ggcatgtatgccatcagacc

SEQ ID NO: 9417 - DNA, 20 bp, Artificial Sequence
  Description of Artificial Sequence: Synthetic oligonucleotide
  Target: ANGPTL3; (+) strand; PAM type: NRG; PAM sequence: AAG
catcagacccagcaactctc

SEQ ID NO: 9418 - DNA, 20 bp, Artificial Sequence
  Description of Artificial Sequence: Synthetic oligonucleotide
  Target: ANGPTL3; (+) strand; PAM type: NRG; PAM sequence: CAG
tgtctactgtgatgttatat

SEQ ID NO: 9419 - DNA, 20 bp, Artificial Sequence
  Description of Artificial Sequence: Synthetic oligonucleotide
  Target: ANGPTL3; (+) strand; PAM type: NRG; PAM sequence: AGG
gtctactgtgatgttatatc

SEQ ID NO: 9420 - DNA, 20 bp, Artificial Sequence
  Description of Artificial Sequence: Synthetic oligonucleotide
  Target: ANGPTL3; (+) strand; PAM type: NRG; PAM sequence: AAG
atatcaggtaaaacctgtct

SEQ ID NO: 9421 - DNA, 20 bp, Artificial Sequence
  Description of Artificial Sequence: Synthetic oligonucleotide
  Target: ANGPTL3; (+) strand; PAM type: NRG; PAM sequence: AGG
tatcaggtaaaacctgtcta

SEQ ID NO: 9422 - DNA, 20 bp, Artificial Sequence
  Description of Artificial Sequence: Synthetic oligonucleotide
  Target: ANGPTL3; (+) strand; PAM type: NRG; PAM sequence: GAG
tcaggtaaaacctgtctaag

SEQ ID NO: 9423 - DNA, 20 bp, Artificial Sequence
  Description of Artificial Sequence: Synthetic oligonucleotide
  Target: ANGPTL3; (+) strand; PAM type: NRG; PAM sequence: TAG
taaaacctgtctaaggagaa

SEQ ID NO: 9424 - DNA, 20 bp, Artificial Sequence
  Description of Artificial Sequence: Synthetic oligonucleotide
  Target: ANGPTL3; (+) strand; PAM type: NRG; PAM sequence: CAG
acctgtctaaggagaataga

SEQ ID NO: 9425 - DNA, 20 bp, Artificial Sequence
  Description of Artificial Sequence: Synthetic oligonucleotide
  Target: ANGPTL3; (+) strand; PAM type: NRG; PAM sequence: TAG
tgtctaaggagaatagacag

SEQ ID NO: 9426 - DNA, 20 bp, Artificial Sequence
  Description of Artificial Sequence: Synthetic oligonucleotide
  Target: ANGPTL3; (+) strand; PAM type: NRG; PAM sequence: TAG
taaggagaatagacagtagt

SEQ ID NO: 9427 - DNA, 20 bp, Artificial Sequence
  Description of Artificial Sequence: Synthetic oligonucleotide
  Target: ANGPTL3; (+) strand; PAM type: NRG; PAM sequence: TAG
tcaacttactcattacgtat

SEQ ID NO: 9428 - DNA, 20 bp, Artificial Sequence
  Description of Artificial Sequence: Synthetic oligonucleotide
  Target: ANGPTL3; (+) strand; PAM type: NRG; PAM sequence: AGG
caacttactcattacgtatt

SEQ ID NO: 9429 - DNA, 20 bp, Artificial Sequence
  Description of Artificial Sequence: Synthetic oligonucleotide
  Target: ANGPTL3; (+) strand; PAM type: NRG; PAM sequence: AAG
cttactcattacgtattagg

SEQ ID NO: 9430 - DNA, 20 bp, Artificial Sequence
  Description of Artificial Sequence: Synthetic oligonucleotide
  Target: ANGPTL3; (+) strand; PAM type: NRG; PAM sequence: TGG
acgtattaggaagattaacc

SEQ ID NO: 9431 - DNA, 20 bp, Artificial Sequence
  Description of Artificial Sequence: Synthetic oligonucleotide
  Target: ANGPTL3; (+) strand; PAM type: NRG; PAM sequence: GAG
tatatatatgaaatatatat

SEQ ID NO: 9432 - DNA, 20 bp, Artificial Sequence
  Description of Artificial Sequence: Synthetic oligonucleotide
  Target: ANGPTL3; (+) strand; PAM type: NRG; PAM sequence: AAG
ttttcctctaaaataatctg

SEQ ID NO: 9433 - DNA, 20 bp, Artificial Sequence
  Description of Artificial Sequence: Synthetic oligonucleotide
  Target: ANGPTL3; (+) strand; PAM type: NRG; PAM sequence: AAG
ctgaagtgactattatcaat

SEQ ID NO: 9434 - DNA, 20 bp, Artificial Sequence
  Description of Artificial Sequence: Synthetic oligonucleotide
  Target: ANGPTL3; (+) strand; PAM type: NRG; PAM sequence: TGG
attgcctttcacttaacttt

SEQ ID NO: 9435 - DNA, 20 bp, Artificial Sequence
  Description of Artificial Sequence: Synthetic oligonucleotide
  Target: ANGPTL3; (+) strand; PAM type: NRG; PAM sequence: GGG
ttgcctttcacttaactttt

SEQ ID NO: 9436 - DNA, 20 bp, Artificial Sequence
  Description of Artificial Sequence: Synthetic oligonucleotide
  Target: ANGPTL3; (+) strand; PAM type: NRG; PAM sequence: AAG
ttaaaatcaaacaaacaaaa

SEQ ID NO: 9437 - DNA, 20 bp, Artificial Sequence
  Description of Artificial Sequence: Synthetic oligonucleotide
  Target: ANGPTL3; (+) strand; PAM type: NRG; PAM sequence: CAG
atgatttcattcattatatt

SEQ ID NO: 9438 - DNA, 20 bp, Artificial Sequence
  Description of Artificial Sequence: Synthetic oligonucleotide
  Target: ANGPTL3; (+) strand; PAM type: NRG; PAM sequence: AGG
tgatttcattcattatattc

SEQ ID NO: 9439 - DNA, 20 bp, Artificial Sequence
  Description of Artificial Sequence: Synthetic oligonucleotide
  Target: ANGPTL3; (+) strand; PAM type: NRG; PAM sequence: TAG
tttcattcattatattcagg

SEQ ID NO: 9440 - DNA, 20 bp, Artificial Sequence
  Description of Artificial Sequence: Synthetic oligonucleotide
  Target: ANGPTL3; (+) strand; PAM type: NRG; PAM sequence: TGG
cattatattcaggtagtcca

SEQ ID NO: 9441 - DNA, 20 bp, Artificial Sequence
  Description of Artificial Sequence: Synthetic oligonucleotide
  Target: ANGPTL3; (+) strand; PAM type: NRG; PAM sequence: TAG
gacattaattcaacatcgaa

SEQ ID NO: 9442 - DNA, 20 bp, Artificial Sequence
  Description of Artificial Sequence: Synthetic oligonucleotide
  Target: ANGPTL3; (+) strand; PAM type: NRG; PAM sequence: TGG
ttaattcaacatcgaataga

SEQ ID NO: 9443 - DNA, 20 bp, Artificial Sequence
  Description of Artificial Sequence: Synthetic oligonucleotide
  Target: ANGPTL3; (+) strand; PAM type: NRG; PAM sequence: TGG
cacaaaacttcaatgaaacg

SEQ ID NO: 9444 - DNA, 20 bp, Artificial Sequence
  Description of Artificial Sequence: Synthetic oligonucleotide
  Target: ANGPTL3; (+) strand; PAM type: NRG; PAM sequence: GGG
acaaaacttcaatgaaacgt

SEQ ID NO: 9445 - DNA, 20 bp, Artificial Sequence
  Description of Artificial Sequence: Synthetic oligonucleotide
  Target: ANGPTL3; (+) strand; PAM type: NRG; PAM sequence: GAG
aaaacttcaatgaaacgtgg

SEQ ID NO: 9446 - DNA, 20 bp, Artificial Sequence
  Description of Artificial Sequence: Synthetic oligonucleotide
  Target: ANGPTL3; (+) strand; PAM type: NRG; PAM sequence: TGG
acgtgggagaactacaaata

SEQ ID NO: 9447 - DNA, 20 bp, Artificial Sequence
  Description of Artificial Sequence: Synthetic oligonucleotide
  Target: ANGPTL3; (+) strand; PAM type: NRG; PAM sequence: TGG
gagaactacaaatatggttt

SEQ ID NO: 9448 - DNA, 20 bp, Artificial Sequence
  Description of Artificial Sequence: Synthetic oligonucleotide
  Target: ANGPTL3; (+) strand; PAM type: NRG; PAM sequence: GGG
agaactacaaatatggtttt

SEQ ID NO: 9449 - DNA, 20 bp, Artificial Sequence
  Description of Artificial Sequence: Synthetic oligonucleotide
  Target: ANGPTL3; (+) strand; PAM type: NRG; PAM sequence: GAG
aactacaaatatggttttgg

SEQ ID NO: 9450 - DNA, 20 bp, Artificial Sequence
  Description of Artificial Sequence: Synthetic oligonucleotide
  Target: ANGPTL3; (+) strand; PAM type: NRG; PAM sequence: AGG
actacaaatatggttttggg

SEQ ID NO: 9451 - DNA, 20 bp, Artificial Sequence
  Description of Artificial Sequence: Synthetic oligonucleotide
  Target: ANGPTL3; (+) strand; PAM type: NRG; PAM sequence: TGG
tatggttttgggaggcttga

SEQ ID NO: 9452 - DNA, 20 bp, Artificial Sequence
  Description of Artificial Sequence: Synthetic oligonucleotide
  Target: ANGPTL3; (+) strand; PAM type: NRG; PAM sequence: AAG
gttttgggaggcttgatggt

SEQ ID NO: 9453 - DNA, 20 bp, Artificial Sequence
  Description of Artificial Sequence: Synthetic oligonucleotide
  Target: ANGPTL3; (+) strand; PAM type: NRG; PAM sequence: AGG
ttttgggaggcttgatggta

SEQ ID NO: 9454 - DNA, 20 bp, Artificial Sequence
  Description of Artificial Sequence: Synthetic oligonucleotide
  Target: ANGPTL3; (+) strand; PAM type: NRG; PAM sequence: GGG
tttgggaggcttgatggtaa

SEQ ID NO: 9455 - DNA, 20 bp, Artificial Sequence
  Description of Artificial Sequence: Synthetic oligonucleotide
  Target: ANGPTL3; (+) strand; PAM type: NRG; PAM sequence: GGG
ttgggaggcttgatggtaag

SEQ ID NO: 9456 - DNA, 20 bp, Artificial Sequence
  Description of Artificial Sequence: Synthetic oligonucleotide
  Target: ANGPTL3; (+) strand; PAM type: NRG; PAM sequence: GAG
ctaatctacaaatatttact

SEQ ID NO: 9457 - DNA, 20 bp, Artificial Sequence
  Description of Artificial Sequence: Synthetic oligonucleotide
  Target: ANGPTL3; (+) strand; PAM type: NRG; PAM sequence: TGG
tatttactgagaacctctta

SEQ ID NO: 9458 - DNA, 20 bp, Artificial Sequence
  Description of Artificial Sequence: Synthetic oligonucleotide
  Target: ANGPTL3; (+) strand; PAM type: NRG; PAM sequence: CAG
actgagaacctcttatggac

SEQ ID NO: 9459 - DNA, 20 bp, Artificial Sequence
  Description of Artificial Sequence: Synthetic oligonucleotide
  Target: ANGPTL3; (+) strand; PAM type: NRG; PAM sequence: AGG
ctgagaacctcttatggacc

SEQ ID NO: 9460 - DNA, 20 bp, Artificial Sequence
  Description of Artificial Sequence: Synthetic oligonucleotide
  Target: ANGPTL3; (+) strand; PAM type: NRG; PAM sequence: TAG
acctcttatggaccaggtat

SEQ ID NO: 9461 - DNA, 20 bp, Artificial Sequence
  Description of Artificial Sequence: Synthetic oligonucleotide
  Target: ANGPTL3; (+) strand; PAM type: NRG; PAM sequence: AGG
cctcttatggaccaggtatt

SEQ ID NO: 9462 - DNA, 20 bp, Artificial Sequence
  Description of Artificial Sequence: Synthetic oligonucleotide
  Target: ANGPTL3; (+) strand; PAM type: NRG; PAM sequence: AAG
tatggaccaggtattaggaa

SEQ ID NO: 9463 - DNA, 20 bp, Artificial Sequence
  Description of Artificial Sequence: Synthetic oligonucleotide
  Target: ANGPTL3; (+) strand; PAM type: NRG; PAM sequence: TAG
ggaccaggtattaggaaaag

SEQ ID NO: 9464 - DNA, 20 bp, Artificial Sequence
  Description of Artificial Sequence: Synthetic oligonucleotide
  Target: ANGPTL3; (+) strand; PAM type: NRG; PAM sequence: GAG
taggaaaagtagtaacgaac

SEQ ID NO: 9465 - DNA, 20 bp, Artificial Sequence
  Description of Artificial Sequence: Synthetic oligonucleotide
  Target: ANGPTL3; (+) strand; PAM type: NRG; PAM sequence: AAG
gaaaagtagtaacgaacgag

SEQ ID NO: 9466 - DNA, 20 bp, Artificial Sequence
  Description of Artificial Sequence: Synthetic oligonucleotide
  Target: ANGPTL3; (+) strand; PAM type: NRG; PAM sequence: CAG
aagtagtaacgaacgagaag

SEQ ID NO: 9467 - DNA, 20 bp, Artificial Sequence
  Description of Artificial Sequence: Synthetic oligonucleotide
  Target: ANGPTL3; (+) strand; PAM type: NRG; PAM sequence: CAG
taacgaacgagaagcagtct

SEQ ID NO: 9468 - DNA, 20 bp, Artificial Sequence
  Description of Artificial Sequence: Synthetic oligonucleotide
  Target: ANGPTL3; (+) strand; PAM type: NRG; PAM sequence: TAG
tcaaacaattacacatttgt

SEQ ID NO: 9469 - DNA, 20 bp, Artificial Sequence
  Description of Artificial Sequence: Synthetic oligonucleotide
  Target: ANGPTL3; (+) strand; PAM type: NRG; PAM sequence: CGG
cttatcacaatttaattcca

SEQ ID NO: 9470 - DNA, 20 bp, Artificial Sequence
  Description of Artificial Sequence: Synthetic oligonucleotide
  Target: ANGPTL3; (+) strand; PAM type: NRG; PAM sequence: AAG
gatcataactataattatta

SEQ ID NO: 9471 - DNA, 20 bp, Artificial Sequence
  Description of Artificial Sequence: Synthetic oligonucleotide
  Target: ANGPTL3; (+) strand; PAM type: NRG; PAM sequence: AAG
ttgattaaatgttatgtcat

SEQ ID NO: 9472 - DNA, 20 bp, Artificial Sequence
  Description of Artificial Sequence: Synthetic oligonucleotide
  Target: ANGPTL3; (+) strand; PAM type: NRG; PAM sequence: TAG
attaaatgttatgtcataag

SEQ ID NO: 9473 - DNA, 20 bp, Artificial Sequence
  Description of Artificial Sequence: Synthetic oligonucleotide
  Target: ANGPTL3; (+) strand; PAM type: NRG; PAM sequence: AAG
aagtagtaactgttacaaat

SEQ ID NO: 9474 - DNA, 20 bp, Artificial Sequence
  Description of Artificial Sequence: Synthetic oligonucleotide
  Target: ANGPTL3; (+) strand; PAM type: NRG; PAM sequence: AAG
tgttacaaataagctgtgaa

SEQ ID NO: 9475 - DNA, 20 bp, Artificial Sequence
  Description of Artificial Sequence: Synthetic oligonucleotide
  Target: ANGPTL3; (+) strand; PAM type: NRG; PAM sequence: TAG
gctgtgaaaagaaccactcc

SEQ ID NO: 9476 - DNA, 20 bp, Artificial Sequence
  Description of Artificial Sequence: Synthetic oligonucleotide
  Target: ANGPTL3; (+) strand; PAM type: NRG; PAM sequence: TAG
aaaagaaccactcctagcat

SEQ ID NO: 9477 - DNA, 20 bp, Artificial Sequence
  Description of Artificial Sequence: Synthetic oligonucleotide
  Target: ANGPTL3; (+) strand; PAM type: NRG; PAM sequence: TGG
cgttttacatatcaattaat

SEQ ID NO: 9478 - DNA, 20 bp, Artificial Sequence
  Description of Artificial Sequence: Synthetic oligonucleotide
  Target: ANGPTL3; (+) strand; PAM type: NRG; PAM sequence: AAG
tttacatatcaattaattgg

SEQ ID NO: 9479 - DNA, 20 bp, Artificial Sequence
  Description of Artificial Sequence: Synthetic oligonucleotide
  Target: ANGPTL3; (+) strand; PAM type: NRG; PAM sequence: AAG
atcaattaattggaagttaa

SEQ ID NO: 9480 - DNA, 20 bp, Artificial Sequence
  Description of Artificial Sequence: Synthetic oligonucleotide
  Target: ANGPTL3; (+) strand; PAM type: NRG; PAM sequence: AGG
tcaattaattggaagttaaa

SEQ ID NO: 9481 - DNA, 20 bp, Artificial Sequence
  Description of Artificial Sequence: Synthetic oligonucleotide
  Target: ANGPTL3; (+) strand; PAM type: NRG; PAM sequence: CAG
taattggaagttaaaaggac

SEQ ID NO: 9482 - DNA, 20 bp, Artificial Sequence
  Description of Artificial Sequence: Synthetic oligonucleotide
  Target: ANGPTL3; (+) strand; PAM type: NRG; PAM sequence: AGG
aattggaagttaaaaggacc

SEQ ID NO: 9483 - DNA, 20 bp, Artificial Sequence
  Description of Artificial Sequence: Synthetic oligonucleotide
  Target: ANGPTL3; (+) strand; PAM type: NRG; PAM sequence: CAG
gttaaaaggaccaggaaact

SEQ ID NO: 9484 - DNA, 20 bp, Artificial Sequence
  Description of Artificial Sequence: Synthetic oligonucleotide
  Target: ANGPTL3; (+) strand; PAM type: NRG; PAM sequence: CAG
gaccaggaaactcagacata

SEQ ID NO: 9485 - DNA, 20 bp, Artificial Sequence
  Description of Artificial Sequence: Synthetic oligonucleotide
  Target: ANGPTL3; (+) strand; PAM type: NRG; PAM sequence: TAG
aattatttaaatataatata

SEQ ID NO: 9486 - DNA, 20 bp, Artificial Sequence
  Description of Artificial Sequence: Synthetic oligonucleotide
  Target: ANGPTL3; (+) strand; PAM type: NRG; PAM sequence: TGG
aatataatatatagaatgta

SEQ ID NO: 9487 - DNA, 20 bp, Artificial Sequence
  Description of Artificial Sequence: Synthetic oligonucleotide
  Target: ANGPTL3; (+) strand; PAM type: NRG; PAM sequence: TAG
atgtatggcttataatgaat

SEQ ID NO: 9488 - DNA, 20 bp, Artificial Sequence
  Description of Artificial Sequence: Synthetic oligonucleotide
  Target: ANGPTL3; (+) strand; PAM type: NRG; PAM sequence: TAG
tattctattttgattacaaa

SEQ ID NO: 9489 - DNA, 20 bp, Artificial Sequence
  Description of Artificial Sequence: Synthetic oligonucleotide
  Target: ANGPTL3; (+) strand; PAM type: NRG; PAM sequence: AAG
ttgattacaaatagtaaaat

SEQ ID NO: 9490 - DNA, 20 bp, Artificial Sequence
  Description of Artificial Sequence: Synthetic oligonucleotide
  Target: ANGPTL3; (+) strand; PAM type: NRG; PAM sequence: AAG
ttacaaatagtaaaataagc

SEQ ID NO: 9491 - DNA, 20 bp, Artificial Sequence
  Description of Artificial Sequence: Synthetic oligonucleotide
  Target: ANGPTL3; (+) strand; PAM type: NRG; PAM sequence: CAG
aaataagcaagataaaataa

SEQ ID NO: 9492 - DNA, 20 bp, Artificial Sequence
  Description of Artificial Sequence: Synthetic oligonucleotide
  Target: ANGPTL3; (+) strand; PAM type: NRG; PAM sequence: AAG
acagatgtttaaaatccaaa

SEQ ID NO: 9493 - DNA, 20 bp, Artificial Sequence
  Description of Artificial Sequence: Synthetic oligonucleotide
  Target: ANGPTL3; (+) strand; PAM type: NRG; PAM sequence: AAG
aaaatccatgaatgatgtct

SEQ ID NO: 9494 - DNA, 20 bp, Artificial Sequence
  Description of Artificial Sequence: Synthetic oligonucleotide
  Target: ANGPTL3; (+) strand; PAM type: NRG; PAM sequence: AAG
tgtctaagtactcacttata

SEQ ID NO: 9495 - DNA, 20 bp, Artificial Sequence
  Description of Artificial Sequence: Synthetic oligonucleotide
  Target: ANGPTL3; (+) strand; PAM type: NRG; PAM sequence: TAG
ctaagtactcacttataaag

SEQ ID NO: 9496 - DNA, 20 bp, Artificial Sequence
  Description of Artificial Sequence: Synthetic oligonucleotide
  Target: ANGPTL3; (+) strand; PAM type: NRG; PAM sequence: AAG
agtactcacttataaagtag

SEQ ID NO: 9497 - DNA, 20 bp, Artificial Sequence
  Description of Artificial Sequence: Synthetic oligonucleotide
  Target: ANGPTL3; (+) strand; PAM type: NRG; PAM sequence: CAG
atatcaaatttttaaatgct

SEQ ID NO: 9498 - DNA, 20 bp, Artificial Sequence
  Description of Artificial Sequence: Synthetic oligonucleotide
  Target: ANGPTL3; (+) strand; PAM type: NRG; PAM sequence: CAG
aaattttgtattcaaactac

SEQ ID NO: 9499 - DNA, 20 bp, Artificial Sequence
  Description of Artificial Sequence: Synthetic oligonucleotide
  Target: ANGPTL3; (+) strand; PAM type: NRG; PAM sequence: AAG
tgtattcaaactaccagtga

SEQ ID NO: 9500 - DNA, 20 bp, Artificial Sequence
  Description of Artificial Sequence: Synthetic oligonucleotide
  Target: ANGPTL3; (+) strand; PAM type: NRG; PAM sequence: TAG
ctaccagtgaaagccctacc

SEQ ID NO: 9501 - DNA, 20 bp, Artificial Sequence
  Description of Artificial Sequence: Synthetic oligonucleotide
  Target: ANGPTL3; (+) strand; PAM type: NRG; PAM sequence: AAG
ccagtgaaagccctacctag

SEQ ID NO: 9502 - DNA, 20 bp, Artificial Sequence
  Description of Artificial Sequence: Synthetic oligonucleotide
  Target: ANGPTL3; (+) strand; PAM type: NRG; PAM sequence: AGG
cagtgaaagccctacctaga

SEQ ID NO: 9503 - DNA, 20 bp, Artificial Sequence
  Description of Artificial Sequence: Synthetic oligonucleotide
  Target: ANGPTL3; (+) strand; PAM type: NRG; PAM sequence: CAG
ccctacctagaaggtatact

SEQ ID NO: 9504 - DNA, 20 bp, Artificial Sequence
  Description of Artificial Sequence: Synthetic oligonucleotide
  Target: ANGPTL3; (+) strand; PAM type: NRG; PAM sequence: AAG
tagaaggtatactcagtgat

SEQ ID NO: 9505 - DNA, 20 bp, Artificial Sequence
  Description of Artificial Sequence: Synthetic oligonucleotide
  Target: ANGPTL3; (+) strand; PAM type: NRG; PAM sequence: TAG
atactcagtgataagttttg

SEQ ID NO: 9506 - DNA, 20 bp, Artificial Sequence
  Description of Artificial Sequence: Synthetic oligonucleotide
  Target: ANGPTL3; (+) strand; PAM type: NRG; PAM sequence: TAG
tgtagctccaaatcttctaa

SEQ ID NO: 9507 - DNA, 20 bp, Artificial Sequence
  Description of Artificial Sequence: Synthetic oligonucleotide
  Target: ANGPTL3; (+) strand; PAM type: NRG; PAM sequence: GAG
gctccaaatcttctaatagt

SEQ ID NO: 9508 - DNA, 20 bp, Artificial Sequence
  Description of Artificial Sequence: Synthetic oligonucleotide
  Target: ANGPTL3; (+) strand; PAM type: NRG; PAM sequence: AAG
tgagtgtaaccccaaaataa

SEQ ID NO: 9509 - DNA, 20 bp, Artificial Sequence
  Description of Artificial Sequence: Synthetic oligonucleotide
  Target: ANGPTL3; (+) strand; PAM type: NRG; PAM sequence: AGG
gagtgtaaccccaaaataaa

SEQ ID NO: 9510 - DNA, 20 bp, Artificial Sequence
  Description of Artificial Sequence: Synthetic oligonucleotide
  Target: ANGPTL3; (+) strand; PAM type: NRG; PAM sequence: CAG
accccaaaataaaaggctga

SEQ ID NO: 9511 - DNA, 20 bp, Artificial Sequence
  Description of Artificial Sequence: Synthetic oligonucleotide
  Target: ANGPTL3; (+) strand; PAM type: NRG; PAM sequence: AGG
ccccaaaataaaaggctgac

SEQ ID NO: 9512 - DNA, 20 bp, Artificial Sequence
  Description of Artificial Sequence: Synthetic oligonucleotide
  Target: ANGPTL3; (+) strand; PAM type: NRG; PAM sequence: AAG
aaaataaaaggctgacaggt

SEQ ID NO: 9513 - DNA, 20 bp, Artificial Sequence
  Description of Artificial Sequence: Synthetic oligonucleotide
  Target: ANGPTL3; (+) strand; PAM type: NRG; PAM sequence: GAG
aaaaggctgacaggtaagtc

SEQ ID NO: 9514 - DNA, 20 bp, Artificial Sequence
  Description of Artificial Sequence: Synthetic oligonucleotide
  Target: ANGPTL3; (+) strand; PAM type: NRG; PAM sequence: TGG
cgagaatactcacttaattc

SEQ ID NO: 9515 - DNA, 20 bp, Artificial Sequence
  Description of Artificial Sequence: Synthetic oligonucleotide
  Target: ANGPTL3; (+) strand; PAM type: NRG; PAM sequence: AAG
aatactcacttaattctggt

SEQ ID NO: 9516 - DNA, 20 bp, Artificial Sequence
  Description of Artificial Sequence: Synthetic oligonucleotide
  Target: ANGPTL3; (+) strand; PAM type: NRG; PAM sequence: AAG
ctcacttaattctggtaaga

SEQ ID NO: 9517 - DNA, 20 bp, Artificial Sequence
  Description of Artificial Sequence: Synthetic oligonucleotide
  Target: ANGPTL3; (+) strand; PAM type: NRG; PAM sequence: CAG
ccatttgtacttgtatttac

SEQ ID NO: 9518 - DNA, 20 bp, Artificial Sequence
  Description of Artificial Sequence: Synthetic oligonucleotide
  Target: ANGPTL3; (+) strand; PAM type: NRG; PAM sequence: AAG
taccagcaatccttaaaatg

SEQ ID NO: 9519 - DNA, 20 bp, Artificial Sequence
  Description of Artificial Sequence: Synthetic oligonucleotide
  Target: ANGPTL3; (+) strand; PAM type: NRG; PAM sequence: TAG
gaagcttcctactaactcaa

SEQ ID NO: 9520 - DNA, 20 bp, Artificial Sequence
  Description of Artificial Sequence: Synthetic oligonucleotide
  Target: ANGPTL3; (+) strand; PAM type: NRG; PAM sequence: AAG
cctactaactcaatagcaat

SEQ ID NO: 9521 - DNA, 20 bp, Artificial Sequence
  Description of Artificial Sequence: Synthetic oligonucleotide
  Target: ANGPTL3; (+) strand; PAM type: NRG; PAM sequence: TAG
actcaatagcaataagacaa

SEQ ID NO: 9522 - DNA, 20 bp, Artificial Sequence
  Description of Artificial Sequence: Synthetic oligonucleotide
  Target: ANGPTL3; (+) strand; PAM type: NRG; PAM sequence: CAG
tagtgaatgtttaatgaaaa

SEQ ID NO: 9523 - DNA, 20 bp, Artificial Sequence
  Description of Artificial Sequence: Synthetic oligonucleotide
  Target: ANGPTL3; (+) strand; PAM type: NRG; PAM sequence: AAG
tttataaatactttaataaa

SEQ ID NO: 9524 - DNA, 20 bp, Artificial Sequence
  Description of Artificial Sequence: Synthetic oligonucleotide
  Target: ANGPTL3; (+) strand; PAM type: NRG; PAM sequence: AGG
ttataaatactttaataaaa

SEQ ID NO: 9525 - DNA, 20 bp, Artificial Sequence
  Description of Artificial Sequence: Synthetic oligonucleotide
  Target: ANGPTL3; (+) strand; PAM type: NRG; PAM sequence: AAG
taataaaaaggattgtgatg

SEQ ID NO: 9526 - DNA, 20 bp, Artificial Sequence
  Description of Artificial Sequence: Synthetic oligonucleotide
  Target: ANGPTL3; (+) strand; PAM type: NRG; PAM sequence: CAG
aaaaataatttttaaaatta

SEQ ID NO: 9527 - DNA, 20 bp, Artificial Sequence
  Description of Artificial Sequence: Synthetic oligonucleotide
  Target: ANGPTL3; (+) strand; PAM type: NRG; PAM sequence: AAG
atttttaaaattacagaaaa

SEQ ID NO: 9528 - DNA, 20 bp, Artificial Sequence
  Description of Artificial Sequence: Synthetic oligonucleotide
  Target: ANGPTL3; (+) strand; PAM type: NRG; PAM sequence: AAG
aattacagaaaaaagttatt

SEQ ID NO: 9529 - DNA, 20 bp, Artificial Sequence
  Description of Artificial Sequence: Synthetic oligonucleotide
  Target: ANGPTL3; (+) strand; PAM type: NRG; PAM sequence: AAG
tattcctgtctttttctaca

SEQ ID NO: 9530 - DNA, 20 bp, Artificial Sequence
  Description of Artificial Sequence: Synthetic oligonucleotide
  Target: ANGPTL3; (+) strand; PAM type: NRG; PAM sequence: AAG
cctgtctttttctacaaaga

SEQ ID NO: 9531 - DNA, 20 bp, Artificial Sequence
  Description of Artificial Sequence: Synthetic oligonucleotide
  Target: ANGPTL3; (+) strand; PAM type: NRG; PAM sequence: AAG
ctacaaagaaagcatacatt

SEQ ID NO: 9532 - DNA, 20 bp, Artificial Sequence
  Description of Artificial Sequence: Synthetic oligonucleotide
  Target: ANGPTL3; (+) strand; PAM type: NRG; PAM sequence: AAG
catacattaagcaaatacca

SEQ ID NO: 9533 - DNA, 20 bp, Artificial Sequence
  Description of Artificial Sequence: Synthetic oligonucleotide
  Target: ANGPTL3; (+) strand; PAM type: NRG; PAM sequence: AGG
atacattaagcaaataccaa

SEQ ID NO: 9534 - DNA, 20 bp, Artificial Sequence
  Description of Artificial Sequence: Synthetic oligonucleotide
  Target: ANGPTL3; (+) strand; PAM type: NRG; PAM sequence: CAG
attaagcaaataccaaaggc

SEQ ID NO: 9535 - DNA, 20 bp, Artificial Sequence
  Description of Artificial Sequence: Synthetic oligonucleotide
  Target: ANGPTL3; (+) strand; PAM type: NRG; PAM sequence: AGG
ttaagcaaataccaaaggcc

SEQ ID NO: 9536 - DNA, 20 bp, Artificial Sequence
  Description of Artificial Sequence: Synthetic oligonucleotide
  Target: ANGPTL3; (+) strand; PAM type: NRG; PAM sequence: AAG
aaaggccaggtttacatttg

SEQ ID NO: 9537 - DNA, 20 bp, Artificial Sequence
  Description of Artificial Sequence: Synthetic oligonucleotide
  Target: ANGPTL3; (+) strand; PAM type: NRG; PAM sequence: AAG
gccaggtttacatttgaaga

SEQ ID NO: 9538 - DNA, 20 bp, Artificial Sequence
  Description of Artificial Sequence: Synthetic oligonucleotide
  Target: ANGPTL3; (+) strand; PAM type: NRG; PAM sequence: AAG
aagtgacattattattactc

SEQ ID NO: 9539 - DNA, 20 bp, Artificial Sequence
  Description of Artificial Sequence: Synthetic oligonucleotide
  Target: ANGPTL3; (+) strand; PAM type: NRG; PAM sequence: TAG
attattattactcaagtctc

SEQ ID NO: 9540 - DNA, 20 bp, Artificial Sequence
  Description of Artificial Sequence: Synthetic oligonucleotide
  Target: ANGPTL3; (+) strand; PAM type: NRG; PAM sequence: AGG
ttattattactcaagtctct

SEQ ID NO: 9541 - DNA, 20 bp, Artificial Sequence
  Description of Artificial Sequence: Synthetic oligonucleotide
  Target: ANGPTL3; (+) strand; PAM type: NRG; PAM sequence: TGG
acacatctcttgactgtata

SEQ ID NO: 9542 - DNA, 20 bp, Artificial Sequence
  Description of Artificial Sequence: Synthetic oligonucleotide
  Target: ANGPTL3; (+) strand; PAM type: NRG; PAM sequence: TAG
tgtatatggatgttaataaa

SEQ ID NO: 9543 - DNA, 20 bp, Artificial Sequence
  Description of Artificial Sequence: Synthetic oligonucleotide
  Target: ANGPTL3; (+) strand; PAM type: NRG; PAM sequence: CAG
ggatgttaataaatagctga

SEQ ID NO: 9544 - DNA, 20 bp, Artificial Sequence
  Description of Artificial Sequence: Synthetic oligonucleotide
  Target: ANGPTL3; (+) strand; PAM type: NRG; PAM sequence: AAG
ttaataaatagctgacagta

SEQ ID NO: 9545 - DNA, 20 bp, Artificial Sequence
  Description of Artificial Sequence: Synthetic oligonucleotide
  Target: ANGPTL3; (+) strand; PAM type: NRG; PAM sequence: AAG
cagtaaagtttatccatata

SEQ ID NO: 9546 - DNA, 20 bp, Artificial Sequence
  Description of Artificial Sequence: Synthetic oligonucleotide
  Target: ANGPTL3; (+) strand; PAM type: NRG; PAM sequence: GAG
aatattcctctaccaatgac

SEQ ID NO: 9547 - DNA, 20 bp, Artificial Sequence
  Description of Artificial Sequence: Synthetic oligonucleotide
  Target: ANGPTL3; (+) strand; PAM type: NRG; PAM sequence: TGG
aataatgtaacacatttcac

SEQ ID NO: 9548 - DNA, 20 bp, Artificial Sequence
  Description of Artificial Sequence: Synthetic oligonucleotide
  Target: ANGPTL3; (+) strand; PAM type: NRG; PAM sequence: TAG
atgtcttgtcatatgcatta

SEQ ID NO: 9549 - DNA, 20 bp, Artificial Sequence
  Description of Artificial Sequence: Synthetic oligonucleotide
  Target: ANGPTL3; (+) strand; PAM type: NRG; PAM sequence: AAG
cttgtcatatgcattataga

SEQ ID NO: 9550 - DNA, 20 bp, Artificial Sequence
  Description of Artificial Sequence: Synthetic oligonucleotide
  Target: ANGPTL3; (+) strand; PAM type: NRG; PAM sequence: AGG
ttgtcatatgcattatagaa

SEQ ID NO: 9551 - DNA, 20 bp, Artificial Sequence
  Description of Artificial Sequence: Synthetic oligonucleotide
  Target: ANGPTL3; (+) strand; PAM type: NRG; PAM sequence: CAG
tgcattatagaaaggataat

SEQ ID NO: 9552 - DNA, 20 bp, Artificial Sequence
  Description of Artificial Sequence: Synthetic oligonucleotide
  Target: ANGPTL3; (+) strand; PAM type: NRG; PAM sequence: CAG
agaaaggataatcagacttt

SEQ ID NO: 9553 - DNA, 20 bp, Artificial Sequence
  Description of Artificial Sequence: Synthetic oligonucleotide
  Target: ANGPTL3; (+) strand; PAM type: NRG; PAM sequence: TAG
ttttaacatttttgtgcaca

SEQ ID NO: 9554 - DNA, 20 bp, Artificial Sequence
  Description of Artificial Sequence: Synthetic oligonucleotide
  Target: ANGPTL3; (+) strand; PAM type: NRG; PAM sequence: AAG
cttcaataaaattgttttaa

SEQ ID NO: 9555 - DNA, 20 bp, Artificial Sequence
  Description of Artificial Sequence: Synthetic oligonucleotide
  Target: ANGPTL3; (+) strand; PAM type: NRG; PAM sequence: AGG
ttcaataaaattgttttaaa

SEQ ID NO: 9556 - DNA, 20 bp, Artificial Sequence
  Description of Artificial Sequence: Synthetic oligonucleotide
  Target: ANGPTL3; (+) strand; PAM type: NRG; PAM sequence: AAG
gttttaaaaggtattatttt

SEQ ID NO: 9557 - DNA, 20 bp, Artificial Sequence
  Description of Artificial Sequence: Synthetic oligonucleotide
  Target: ANGPTL3; (+) strand; PAM type: NRG; PAM sequence: AAG
taagatacactaaaatgatc

SEQ ID NO: 9558 - DNA, 20 bp, Artificial Sequence
  Description of Artificial Sequence: Synthetic oligonucleotide
  Target: ANGPTL3; (+) strand; PAM type: NRG; PAM sequence: AGG
aagatacactaaaatgatca

SEQ ID NO: 9559 - DNA, 20 bp, Artificial Sequence
  Description of Artificial Sequence: Synthetic oligonucleotide
  Target: ANGPTL3; (+) strand; PAM type: NRG; PAM sequence: GGG
agatacactaaaatgatcaa

SEQ ID NO: 9560 - DNA, 20 bp, Artificial Sequence
  Description of Artificial Sequence: Synthetic oligonucleotide
  Target: ANGPTL3; (+) strand; PAM type: NRG; PAM sequence: AAG
ctaaaatgatcaagggattc

SEQ ID NO: 9561 - DNA, 20 bp, Artificial Sequence
  Description of Artificial Sequence: Synthetic oligonucleotide
  Target: ANGPTL3; (+) strand; PAM type: NRG; PAM sequence: TAG
tcaagactaaacaactcaat

SEQ ID NO: 9562 - DNA, 20 bp, Artificial Sequence
  Description of Artificial Sequence: Synthetic oligonucleotide
  Target: ANGPTL3; (+) strand; PAM type: NRG; PAM sequence: CAG
aaaacacttaaaaaaactgt

SEQ ID NO: 9563 - DNA, 20 bp, Artificial Sequence
  Description of Artificial Sequence: Synthetic oligonucleotide
  Target: ANGPTL3; (+) strand; PAM type: NRG; PAM sequence: CAG
aacctgtacttaataactca

SEQ ID NO: 9564 - DNA, 20 bp, Artificial Sequence
  Description of Artificial Sequence: Synthetic oligonucleotide
  Target: ANGPTL3; (+) strand; PAM type: NRG; PAM sequence: CAG
atttttaaaacttttctttt

SEQ ID NO: 9565 - DNA, 20 bp, Artificial Sequence
  Description of Artificial Sequence: Synthetic oligonucleotide
  Target: ANGPTL3; (+) strand; PAM type: NRG; PAM sequence: AGG
tttttaaaacttttcttttc

SEQ ID NO: 9566 - DNA, 20 bp, Artificial Sequence
  Description of Artificial Sequence: Synthetic oligonucleotide
  Target: ANGPTL3; (+) strand; PAM type: NRG; PAM sequence: GAG
tttaaaacttttcttttcag

SEQ ID NO: 9567 - DNA, 20 bp, Artificial Sequence
  Description of Artificial Sequence: Synthetic oligonucleotide
  Target: ANGPTL3; (+) strand; PAM type: NRG; PAM sequence: TGG
ttttcttttcaggagaattt

SEQ ID NO: 9568 - DNA, 20 bp, Artificial Sequence
  Description of Artificial Sequence: Synthetic oligonucleotide
  Target: ANGPTL3; (+) strand; PAM type: NRG; PAM sequence: TGG
cttttcaggagaattttggt

SEQ ID NO: 9569 - DNA, 20 bp, Artificial Sequence
  Description of Artificial Sequence: Synthetic oligonucleotide
  Target: ANGPTL3; (+) strand; PAM type: NRG; PAM sequence: GGG
ttttcaggagaattttggtt

SEQ ID NO: 9570 - DNA, 20 bp, Artificial Sequence
  Description of Artificial Sequence: Synthetic oligonucleotide
  Target: ANGPTL3; (+) strand; PAM type: NRG; PAM sequence: TAG
aggagaattttggttgggcc

SEQ ID NO: 9571 - DNA, 20 bp, Artificial Sequence
  Description of Artificial Sequence: Synthetic oligonucleotide
  Target: ANGPTL3; (+) strand; PAM type: NRG; PAM sequence: GAG
gagaattttggttgggccta

SEQ ID NO: 9572 - DNA, 20 bp, Artificial Sequence
  Description of Artificial Sequence: Synthetic oligonucleotide
  Target: ANGPTL3; (+) strand; PAM type: NRG; PAM sequence: AAG
aattttggttgggcctagag

SEQ ID NO: 9573 - DNA, 20 bp, Artificial Sequence
  Description of Artificial Sequence: Synthetic oligonucleotide
  Target: ANGPTL3; (+) strand; PAM type: NRG; PAM sequence: TAG
cctagagaagatatactcca

SEQ ID NO: 9574 - DNA, 20 bp, Artificial Sequence
  Description of Artificial Sequence: Synthetic oligonucleotide
  Target: ANGPTL3; (+) strand; PAM type: NRG; PAM sequence: AAG
agaagatatactccatagtg

SEQ ID NO: 9575 - DNA, 20 bp, Artificial Sequence
  Description of Artificial Sequence: Synthetic oligonucleotide
  Target: ANGPTL3; (+) strand; PAM type: NRG; PAM sequence: GAG
ctaattatgttttacgaatt

SEQ ID NO: 9576 - DNA, 20 bp, Artificial Sequence
  Description of Artificial Sequence: Synthetic oligonucleotide
  Target: ANGPTL3; (+) strand; PAM type: NRG; PAM sequence: TGG
ttatgttttacgaattgagt

SEQ ID NO: 9577 - DNA, 20 bp, Artificial Sequence
  Description of Artificial Sequence: Synthetic oligonucleotide
  Target: ANGPTL3; (+) strand; PAM type: NRG; PAM sequence: AAG
tgttttacgaattgagttgg

SEQ ID NO: 9578 - DNA, 20 bp, Artificial Sequence
  Description of Artificial Sequence: Synthetic oligonucleotide
  Target: ANGPTL3; (+) strand; PAM type: NRG; PAM sequence: TGG
tacgaattgagttggaagac

SEQ ID NO: 9579 - DNA, 20 bp, Artificial Sequence
  Description of Artificial Sequence: Synthetic oligonucleotide
  Target: ANGPTL3; (+) strand; PAM type: NRG; PAM sequence: AAG
aattgagttggaagactgga

SEQ ID NO: 9580 - DNA, 20 bp, Artificial Sequence
  Description of Artificial Sequence: Synthetic oligonucleotide
  Target: ANGPTL3; (+) strand; PAM type: NRG; PAM sequence: TGG
tattgaatattctttttact

SEQ ID NO: 9581 - DNA, 20 bp, Artificial Sequence
  Description of Artificial Sequence: Synthetic oligonucleotide
  Target: ANGPTL3; (+) strand; PAM type: NRG; PAM sequence: GGG
attgaatattctttttactt

SEQ ID NO: 9582 - DNA, 20 bp, Artificial Sequence
  Description of Artificial Sequence: Synthetic oligonucleotide
  Target: ANGPTL3; (+) strand; PAM type: NRG; PAM sequence: TAG
aaccaactatacgctacatc

SEQ ID NO: 9583 - DNA, 20 bp, Artificial Sequence
  Description of Artificial Sequence: Synthetic oligonucleotide
  Target: ANGPTL3; (+) strand; PAM type: NRG; PAM sequence: TGG
ctacatctagttgcgattac

SEQ ID NO: 9584 - DNA, 20 bp, Artificial Sequence
  Description of Artificial Sequence: Synthetic oligonucleotide
  Target: ANGPTL3; (+) strand; PAM type: NRG; PAM sequence: CGG
caatgtccccaatgcaatcc

SEQ ID NO: 9585 - DNA, 20 bp, Artificial Sequence
  Description of Artificial Sequence: Synthetic oligonucleotide
  Target: ANGPTL3; (+) strand; PAM type: NRG; PAM sequence: AAG
caatgcaatcccggaaaaca

SEQ ID NO: 9586 - DNA, 20 bp, Artificial Sequence
  Description of Artificial Sequence: Synthetic oligonucleotide
  Target: ANGPTL3; (+) strand; PAM type: NRG; PAM sequence: TGG
aatcccggaaaacaaagatt

SEQ ID NO: 9587 - DNA, 20 bp, Artificial Sequence
  Description of Artificial Sequence: Synthetic oligonucleotide
  Target: ANGPTL3; (+) strand; PAM type: NRG; PAM sequence: TGG
aagatttggtgttttctact

SEQ ID NO: 9588 - DNA, 20 bp, Artificial Sequence
  Description of Artificial Sequence: Synthetic oligonucleotide
  Target: ANGPTL3; (+) strand; PAM type: NRG; PAM sequence: GGG
agatttggtgttttctactt

SEQ ID NO: 9589 - DNA, 20 bp, Artificial Sequence
  Description of Artificial Sequence: Synthetic oligonucleotide
  Target: ANGPTL3; (+) strand; PAM type: NRG; PAM sequence: AAG
gttttctacttgggatcaca

SEQ ID NO: 9590 - DNA, 20 bp, Artificial Sequence
  Description of Artificial Sequence: Synthetic oligonucleotide
  Target: ANGPTL3; (+) strand; PAM type: NRG; PAM sequence: AAG
tacttgggatcacaaagcaa

SEQ ID NO: 9591 - DNA, 20 bp, Artificial Sequence
  Description of Artificial Sequence: Synthetic oligonucleotide
  Target: ANGPTL3; (+) strand; PAM type: NRG; PAM sequence: AGG
acttgggatcacaaagcaaa

SEQ ID NO: 9592 - DNA, 20 bp, Artificial Sequence
  Description of Artificial Sequence: Synthetic oligonucleotide
  Target: ANGPTL3; (+) strand; PAM type: NRG; PAM sequence: CAG
aaaaggacacttcaactgtc

SEQ ID NO: 9593 - DNA, 20 bp, Artificial Sequence
  Description of Artificial Sequence: Synthetic oligonucleotide
  Target: ANGPTL3; (+) strand; PAM type: NRG; PAM sequence: GAG
aaggacacttcaactgtcca

SEQ ID NO: 9594 - DNA, 20 bp, Artificial Sequence
  Description of Artificial Sequence: Synthetic oligonucleotide
  Target: ANGPTL3; (+) strand; PAM type: NRG; PAM sequence: AGG
aggacacttcaactgtccag

SEQ ID NO: 9595 - DNA, 20 bp, Artificial Sequence
  Description of Artificial Sequence: Synthetic oligonucleotide
  Target: ANGPTL3; (+) strand; PAM type: NRG; PAM sequence: GGG
ggacacttcaactgtccaga

SEQ ID NO: 9596 - DNA, 20 bp, Artificial Sequence
  Description of Artificial Sequence: Synthetic oligonucleotide
  Target: ANGPTL3; (+) strand; PAM type: NRG; PAM sequence: CAG
caactgtccagagggttatt

SEQ ID NO: 9597 - DNA, 20 bp, Artificial Sequence
  Description of Artificial Sequence: Synthetic oligonucleotide
  Target: ANGPTL3; (+) strand; PAM type: NRG; PAM sequence: AGG
aactgtccagagggttattc

SEQ ID NO: 9598 - DNA, 20 bp, Artificial Sequence
  Description of Artificial Sequence: Synthetic oligonucleotide
  Target: ANGPTL3; (+) strand; PAM type: NRG; PAM sequence: AAG
actttattttcatatcttca

SEQ ID NO: 9599 - DNA, 20 bp, Artificial Sequence
  Description of Artificial Sequence: Synthetic oligonucleotide
  Target: ANGPTL3; (+) strand; PAM type: NRG; PAM sequence: TAG
aaagtatcttcccacattat

SEQ ID NO: 9600 - DNA, 20 bp, Artificial Sequence
  Description of Artificial Sequence: Synthetic oligonucleotide
  Target: ANGPTL3; (+) strand; PAM type: NRG; PAM sequence: AAG
taaaaatccgaatcccaaat

SEQ ID NO: 9601 - DNA, 20 bp, Artificial Sequence
  Description of Artificial Sequence: Synthetic oligonucleotide
  Target: ANGPTL3; (+) strand; PAM type: NRG; PAM sequence: TAG
ccaaataagcgttttctctc

SEQ ID NO: 9602 - DNA, 20 bp, Artificial Sequence
  Description of Artificial Sequence: Synthetic oligonucleotide
  Target: ANGPTL3; (+) strand; PAM type: NRG; PAM sequence: AAG
aaacctcttaactataatga

SEQ ID NO: 9603 - DNA, 20 bp, Artificial Sequence
  Description of Artificial Sequence: Synthetic oligonucleotide
  Target: ANGPTL3; (+) strand; PAM type: NRG; PAM sequence: TAG
tataatgaaagtgttcattc

SEQ ID NO: 9604 - DNA, 20 bp, Artificial Sequence
  Description of Artificial Sequence: Synthetic oligonucleotide
  Target: ANGPTL3; (+) strand; PAM type: NRG; PAM sequence: CAG
agtgttcattctagttcaat

SEQ ID NO: 9605 - DNA, 20 bp, Artificial Sequence
  Description of Artificial Sequence: Synthetic oligonucleotide
  Target: ANGPTL3; (+) strand; PAM type: NRG; PAM sequence: AGG
gtgttcattctagttcaatc

SEQ ID NO: 9606 - DNA, 20 bp, Artificial Sequence
  Description of Artificial Sequence: Synthetic oligonucleotide
  Target: ANGPTL3; (+) strand; PAM type: NRG; PAM sequence: CAG
attttacctctaatcttcct

SEQ ID NO: 9607 - DNA, 20 bp, Artificial Sequence
  Description of Artificial Sequence: Synthetic oligonucleotide
  Target: ANGPTL3; (+) strand; PAM type: NRG; PAM sequence: TGG
tcctcagattttctattttt

SEQ ID NO: 9608 - DNA, 20 bp, Artificial Sequence
  Description of Artificial Sequence: Synthetic oligonucleotide
  Target: ANGPTL3; (+) strand; PAM type: NRG; PAM sequence: TAG
tcagattttctattttttgg

SEQ ID NO: 9609 - DNA, 20 bp, Artificial Sequence
  Description of Artificial Sequence: Synthetic oligonucleotide
  Target: ANGPTL3; (+) strand; PAM type: NRG; PAM sequence: TAG
ttctattttttggtagtgta

SEQ ID NO: 9610 - DNA, 20 bp, Artificial Sequence
  Description of Artificial Sequence: Synthetic oligonucleotide
  Target: ANGPTL3; (+) strand; PAM type: NRG; PAM sequence: CAG
tagtgtatagattatttata

SEQ ID NO: 9611 - DNA, 20 bp, Artificial Sequence
  Description of Artificial Sequence: Synthetic oligonucleotide
  Target: ANGPTL3; (+) strand; PAM type: NRG; PAM sequence: TGG
ttatacagattatttaaaat

SEQ ID NO: 9612 - DNA, 20 bp, Artificial Sequence
  Description of Artificial Sequence: Synthetic oligonucleotide
  Target: ANGPTL3; (+) strand; PAM type: NRG; PAM sequence: GGG
tatacagattatttaaaatt

SEQ ID NO: 9613 - DNA, 20 bp, Artificial Sequence
  Description of Artificial Sequence: Synthetic oligonucleotide
  Target: ANGPTL3; (+) strand; PAM type: NRG; PAM sequence: CAG
atttaaaattgggacttata

SEQ ID NO: 9614 - DNA, 20 bp, Artificial Sequence
  Description of Artificial Sequence: Synthetic oligonucleotide
  Target: ANGPTL3; (+) strand; PAM type: NRG; PAM sequence: TGG
ttatacagattatttaaaac

SEQ ID NO: 9615 - DNA, 20 bp, Artificial Sequence
  Description of Artificial Sequence: Synthetic oligonucleotide
  Target: ANGPTL3; (+) strand; PAM type: NRG; PAM sequence: GGG
tatacagattatttaaaact

SEQ ID NO: 9616 - DNA, 20 bp, Artificial Sequence
  Description of Artificial Sequence: Synthetic oligonucleotide
  Target: ANGPTL3; (+) strand; PAM type: NRG; PAM sequence: AAG
taaaacactgtaatatttat

SEQ ID NO: 9617 - DNA, 20 bp, Artificial Sequence
  Description of Artificial Sequence: Synthetic oligonucleotide
  Target: ANGPTL3; (+) strand; PAM type: NRG; PAM sequence: AAG
acactgtaatatttataaga

SEQ ID NO: 9618 - DNA, 20 bp, Artificial Sequence
  Description of Artificial Sequence: Synthetic oligonucleotide
  Target: ANGPTL3; (+) strand; PAM type: NRG; PAM sequence: AGG
cactgtaatatttataagaa

SEQ ID NO: 9619 - DNA, 20 bp, Artificial Sequence
  Description of Artificial Sequence: Synthetic oligonucleotide
  Target: ANGPTL3; (+) strand; PAM type: NRG; PAM sequence: AAG
tgtaatatttataagaaagg

SEQ ID NO: 9620 - DNA, 20 bp, Artificial Sequence
  Description of Artificial Sequence: Synthetic oligonucleotide
  Target: ANGPTL3; (+) strand; PAM type: NRG; PAM sequence: CGG
aagaaaggaagataaactta

SEQ ID NO: 9621 - DNA, 20 bp, Artificial Sequence
  Description of Artificial Sequence: Synthetic oligonucleotide
  Target: ANGPTL3; (+) strand; PAM type: NRG; PAM sequence: GGG
agaaaggaagataaacttac

SEQ ID NO: 9622 - DNA, 20 bp, Artificial Sequence
  Description of Artificial Sequence: Synthetic oligonucleotide
  Target: ANGPTL3; (+) strand; PAM type: NRG; PAM sequence: GGG
gaaaggaagataaacttacg

SEQ ID NO: 9623 - DNA, 20 bp, Artificial Sequence
  Description of Artificial Sequence: Synthetic oligonucleotide
  Target: ANGPTL3; (+) strand; PAM type: NRG; PAM sequence: CAG
gataaacttacggggaaata

SEQ ID NO: 9624 - DNA, 20 bp, Artificial Sequence
  Description of Artificial Sequence: Synthetic oligonucleotide
  Target: ANGPTL3; (+) strand; PAM type: NRG; PAM sequence: CAG
cttacggggaaatacagtaa

SEQ ID NO: 9625 - DNA, 20 bp, Artificial Sequence
  Description of Artificial Sequence: Synthetic oligonucleotide
  Target: ANGPTL3; (+) strand; PAM type: NRG; PAM sequence: GAG
cagtaacagtaactacatac

SEQ ID NO: 9626 - DNA, 20 bp, Artificial Sequence
  Description of Artificial Sequence: Synthetic oligonucleotide
  Target: ANGPTL3; (+) strand; PAM type: NRG; PAM sequence: TAG
aattgcatatctatctcctt

SEQ ID NO: 9627 - DNA, 20 bp, Artificial Sequence
  Description of Artificial Sequence: Synthetic oligonucleotide
  Target: ANGPTL3; (+) strand; PAM type: NRG; PAM sequence: AGG
attgcatatctatctccttt

SEQ ID NO: 9628 - DNA, 20 bp, Artificial Sequence
  Description of Artificial Sequence: Synthetic oligonucleotide
  Target: ANGPTL3; (+) strand; PAM type: NRG; PAM sequence: GAG
tgcatatctatctcctttag

SEQ ID NO: 9629 - DNA, 20 bp, Artificial Sequence
  Description of Artificial Sequence: Synthetic oligonucleotide
  Target: ANGPTL3; (+) strand; PAM type: NRG; PAM sequence: AGG
gcatatctatctcctttagg

SEQ ID NO: 9630 - DNA, 20 bp, Artificial Sequence
  Description of Artificial Sequence: Synthetic oligonucleotide
  Target: ANGPTL3; (+) strand; PAM type: NRG; PAM sequence: TGG
atctatctcctttaggaggc

SEQ ID NO: 9631 - DNA, 20 bp, Artificial Sequence
  Description of Artificial Sequence: Synthetic oligonucleotide
  Target: ANGPTL3; (+) strand; PAM type: NRG; PAM sequence: TGG
tatctcctttaggaggctgg

SEQ ID NO: 9632 - DNA, 20 bp, Artificial Sequence
  Description of Artificial Sequence: Synthetic oligonucleotide
  Target: ANGPTL3; (+) strand; PAM type: NRG; PAM sequence: TGG
ctcctttaggaggctggtgg

SEQ ID NO: 9633 - DNA, 20 bp, Artificial Sequence
  Description of Artificial Sequence: Synthetic oligonucleotide
  Target: ANGPTL3; (+) strand; PAM type: NRG; PAM sequence: GAG
gaggctggtggtggcatgat

SEQ ID NO: 9634 - DNA, 20 bp, Artificial Sequence
  Description of Artificial Sequence: Synthetic oligonucleotide
  Target: ANGPTL3; (+) strand; PAM type: NRG; PAM sequence: TGG
tggtggtggcatgatgagtg

SEQ ID NO: 9635 - DNA, 20 bp, Artificial Sequence
  Description of Artificial Sequence: Synthetic oligonucleotide
  Target: ANGPTL3; (+) strand; PAM type: NRG; PAM sequence: GAG
gtggtggcatgatgagtgtg

SEQ ID NO: 9636 - DNA, 20 bp, Artificial Sequence
  Description of Artificial Sequence: Synthetic oligonucleotide
  Target: ANGPTL3; (+) strand; PAM type: NRG; PAM sequence: TGG
tgtggagaaaacaacctaaa

SEQ ID NO: 9637 - DNA, 20 bp, Artificial Sequence
  Description of Artificial Sequence: Synthetic oligonucleotide
  Target: ANGPTL3; (+) strand; PAM type: NRG; PAM sequence: AAG
aatggtaaatataacaaacc

SEQ ID NO: 9638 - DNA, 20 bp, Artificial Sequence
  Description of Artificial Sequence: Synthetic oligonucleotide
  Target: ANGPTL3; (+) strand; PAM type: NRG; PAM sequence: GAG
tggtaaatataacaaaccaa

SEQ ID NO: 9639 - DNA, 20 bp, Artificial Sequence
  Description of Artificial Sequence: Synthetic oligonucleotide
  Target: ANGPTL3; (+) strand; PAM type: NRG; PAM sequence: AAG
acaaaccaagagcaaaatct

SEQ ID NO: 9640 - DNA, 20 bp, Artificial Sequence
  Description of Artificial Sequence: Synthetic oligonucleotide
  Target: ANGPTL3; (+) strand; PAM type: NRG; PAM sequence: CAG
accaagagcaaaatctaagc

SEQ ID NO: 9641 - DNA, 20 bp, Artificial Sequence
  Description of Artificial Sequence: Synthetic oligonucleotide
  Target: ANGPTL3; (+) strand; PAM type: NRG; PAM sequence: GAG
caagagcaaaatctaagcca

SEQ ID NO: 9642 - DNA, 20 bp, Artificial Sequence
  Description of Artificial Sequence: Synthetic oligonucleotide
  Target: ANGPTL3; (+) strand; PAM type: NRG; PAM sequence: GAG
agagcaaaatctaagccaga

SEQ ID NO: 9643 - DNA, 20 bp, Artificial Sequence
  Description of Artificial Sequence: Synthetic oligonucleotide
  Target: ANGPTL3; (+) strand; PAM type: NRG; PAM sequence: AGG
gagcaaaatctaagccagag

SEQ ID NO: 9644 - DNA, 20 bp, Artificial Sequence
  Description of Artificial Sequence: Synthetic oligonucleotide
  Target: ANGPTL3; (+) strand; PAM type: NRG; PAM sequence: GAG
gcaaaatctaagccagagag

SEQ ID NO: 9645 - DNA, 20 bp, Artificial Sequence
  Description of Artificial Sequence: Synthetic oligonucleotide
  Target: ANGPTL3; (+) strand; PAM type: NRG; PAM sequence: AAG
aaatctaagccagagaggag

SEQ ID NO: 9646 - DNA, 20 bp, Artificial Sequence
  Description of Artificial Sequence: Synthetic oligonucleotide
  Target: ANGPTL3; (+) strand; PAM type: NRG; PAM sequence: GAG
atctaagccagagaggagaa

SEQ ID NO: 9647 - DNA, 20 bp, Artificial Sequence
  Description of Artificial Sequence: Synthetic oligonucleotide
  Target: ANGPTL3; (+) strand; PAM type: NRG; PAM sequence: AGG
tctaagccagagaggagaag

SEQ ID NO: 9648 - DNA, 20 bp, Artificial Sequence
  Description of Artificial Sequence: Synthetic oligonucleotide
  Target: ANGPTL3; (+) strand; PAM type: NRG; PAM sequence: TGG
agaggagaagaggattatct

SEQ ID NO: 9649 - DNA, 20 bp, Artificial Sequence
  Description of Artificial Sequence: Synthetic oligonucleotide
  Target: ANGPTL3; (+) strand; PAM type: NRG; PAM sequence: AAG
ggagaagaggattatcttgg

SEQ ID NO: 9650 - DNA, 20 bp, Artificial Sequence
  Description of Artificial Sequence: Synthetic oligonucleotide
  Target: ANGPTL3; (+) strand; PAM type: NRG; PAM sequence: TGG
ttatcttggaagtctcaaaa

SEQ ID NO: 9651 - DNA, 20 bp, Artificial Sequence
  Description of Artificial Sequence: Synthetic oligonucleotide
  Target: ANGPTL3; (+) strand; PAM type: NRG; PAM sequence: AAG
tcttggaagtctcaaaatgg

SEQ ID NO: 9652 - DNA, 20 bp, Artificial Sequence
  Description of Artificial Sequence: Synthetic oligonucleotide
  Target: ANGPTL3; (+) strand; PAM type: NRG; PAM sequence: AGG
cttggaagtctcaaaatgga

SEQ ID NO: 9653 - DNA, 20 bp, Artificial Sequence
  Description of Artificial Sequence: Synthetic oligonucleotide
  Target: ANGPTL3; (+) strand; PAM type: NRG; PAM sequence: CAG
caaaatgttgatccatccaa

SEQ ID NO: 9654 - DNA, 20 bp, Artificial Sequence
  Description of Artificial Sequence: Synthetic oligonucleotide
  Target: ANGPTL3; (+) strand; PAM type: NRG; PAM sequence: CAG
gttgatccatccaacagatt

SEQ ID NO: 9655 - DNA, 20 bp, Artificial Sequence
  Description of Artificial Sequence: Synthetic oligonucleotide
  Target: ANGPTL3; (+) strand; PAM type: NRG; PAM sequence: AAG
atccatccaacagattcaga

SEQ ID NO: 9656 - DNA, 20 bp, Artificial Sequence
  Description of Artificial Sequence: Synthetic oligonucleotide
  Target: ANGPTL3; (+) strand; PAM type: NRG; PAM sequence: GAG
cagaaagctttgaatgaact

SEQ ID NO: 9657 - DNA, 20 bp, Artificial Sequence
  Description of Artificial Sequence: Synthetic oligonucleotide
  Target: ANGPTL3; (+) strand; PAM type: NRG; PAM sequence: AGG
agaaagctttgaatgaactg

SEQ ID NO: 9658 - DNA, 20 bp, Artificial Sequence
  Description of Artificial Sequence: Synthetic oligonucleotide
  Target: ANGPTL3; (+) strand; PAM type: NRG; PAM sequence: AAG
atgaactgaggcaaatttaa

SEQ ID NO: 9659 - DNA, 20 bp, Artificial Sequence
  Description of Artificial Sequence: Synthetic oligonucleotide
  Target: ANGPTL3; (+) strand; PAM type: NRG; PAM sequence: AGG
tgaactgaggcaaatttaaa

SEQ ID NO: 9660 - DNA, 20 bp, Artificial Sequence
  Description of Artificial Sequence: Synthetic oligonucleotide
  Target: ANGPTL3; (+) strand; PAM type: NRG; PAM sequence: AAG
ttaaacattaacctcattcc

SEQ ID NO: 9661 - DNA, 20 bp, Artificial Sequence
  Description of Artificial Sequence: Synthetic oligonucleotide
  Target: ANGPTL3; (+) strand; PAM type: NRG; PAM sequence: TGG
aacctcattccaagttaatg

SEQ ID NO: 9662 - DNA, 20 bp, Artificial Sequence
  Description of Artificial Sequence: Synthetic oligonucleotide
  Target: ANGPTL3; (+) strand; PAM type: NRG; PAM sequence: TGG
gttaatgtggtctaataatc

SEQ ID NO: 9663 - DNA, 20 bp, Artificial Sequence
  Description of Artificial Sequence: Synthetic oligonucleotide
  Target: ANGPTL3; (+) strand; PAM type: NRG; PAM sequence: AAG
taatctggtattaaatcctt

SEQ ID NO: 9664 - DNA, 20 bp, Artificial Sequence
  Description of Artificial Sequence: Synthetic oligonucleotide
  Target: ANGPTL3; (+) strand; PAM type: NRG; PAM sequence: GAG
atctggtattaaatccttaa

SEQ ID NO: 9665 - DNA, 20 bp, Artificial Sequence
  Description of Artificial Sequence: Synthetic oligonucleotide
  Target: ANGPTL3; (+) strand; PAM type: NRG; PAM sequence: AAG
ggtattaaatccttaagaga

SEQ ID NO: 9666 - DNA, 20 bp, Artificial Sequence
  Description of Artificial Sequence: Synthetic oligonucleotide
  Target: ANGPTL3; (+) strand; PAM type: NRG; PAM sequence: GAG
aaatccttaagagaaagctt

SEQ ID NO: 9667 - DNA, 20 bp, Artificial Sequence
  Description of Artificial Sequence: Synthetic oligonucleotide
  Target: ANGPTL3; (+) strand; PAM type: NRG; PAM sequence: TAG
ttaagagaaagcttgagaaa

SEQ ID NO: 9668 - DNA, 20 bp, Artificial Sequence
  Description of Artificial Sequence: Synthetic oligonucleotide
  Target: ANGPTL3; (+) strand; PAM type: NRG; PAM sequence: AAG
aatagattttttttatctta

SEQ ID NO: 9669 - DNA, 20 bp, Artificial Sequence
  Description of Artificial Sequence: Synthetic oligonucleotide
  Target: ANGPTL3; (+) strand; PAM type: NRG; PAM sequence: AAG
cttaaagtcactgtctattt

SEQ ID NO: 9670 - DNA, 20 bp, Artificial Sequence
  Description of Artificial Sequence: Synthetic oligonucleotide
  Target: ANGPTL3; (+) strand; PAM type: NRG; PAM sequence: AAG
catacaatcacataacctta

SEQ ID NO: 9671 - DNA, 20 bp, Artificial Sequence
  Description of Artificial Sequence: Synthetic oligonucleotide
  Target: ANGPTL3; (+) strand; PAM type: NRG; PAM sequence: TGG
ttgttttaaattttgtgatg

SEQ ID NO: 9672 - DNA, 20 bp, Artificial Sequence
  Description of Artificial Sequence: Synthetic oligonucleotide
  Target: ANGPTL3; (+) strand; PAM type: NRG; PAM sequence: GGG
tgttttaaattttgtgatgt

SEQ ID NO: 9673 - DNA, 20 bp, Artificial Sequence
  Description of Artificial Sequence: Synthetic oligonucleotide
  Target: ANGPTL3; (+) strand; PAM type: NRG; PAM sequence: TAG
tgtgatgtgggaatcaattt

SEQ ID NO: 9674 - DNA, 20 bp, Artificial Sequence
  Description of Artificial Sequence: Synthetic oligonucleotide
  Target: ANGPTL3; (+) strand; PAM type: NRG; PAM sequence: TGG
atgtgggaatcaattttaga

SEQ ID NO: 9675 - DNA, 20 bp, Artificial Sequence
  Description of Artificial Sequence: Synthetic oligonucleotide
  Target: ANGPTL3; (+) strand; PAM type: NRG; PAM sequence: TAG
aattttagatggtcacaatc

SEQ ID NO: 9676 - DNA, 20 bp, Artificial Sequence
  Description of Artificial Sequence: Synthetic oligonucleotide
  Target: ANGPTL3; (+) strand; PAM type: NRG; PAM sequence: TAG
acaatctagattataatcaa

SEQ ID NO: 9677 - DNA, 20 bp, Artificial Sequence
  Description of Artificial Sequence: Synthetic oligonucleotide
  Target: ANGPTL3; (+) strand; PAM type: NRG; PAM sequence: AGG
caatctagattataatcaat

SEQ ID NO: 9678 - DNA, 20 bp, Artificial Sequence
  Description of Artificial Sequence: Synthetic oligonucleotide
  Target: ANGPTL3; (+) strand; PAM type: NRG; PAM sequence: TAG
acttttctaaataaaaaatt

SEQ ID NO: 9679 - DNA, 20 bp, Artificial Sequence
  Description of Artificial Sequence: Synthetic oligonucleotide
  Target: ANGPTL3; (+) strand; PAM type: NRG; PAM sequence: GAG
ttttctaaataaaaaattta

SEQ ID NO: 9680 - DNA, 20 bp, Artificial Sequence
  Description of Artificial Sequence: Synthetic oligonucleotide
  Target: ANGPTL3; (+) strand; PAM type: NRG; PAM sequence: AAG
tttagagacttttattttaa

SEQ ID NO: 9681 - DNA, 20 bp, Artificial Sequence
  Description of Artificial Sequence: Synthetic oligonucleotide
  Target: ANGPTL3; (+) strand; PAM type: NRG; PAM sequence: AGG
ttagagacttttattttaaa

SEQ ID NO: 9682 - DNA, 20 bp, Artificial Sequence
  Description of Artificial Sequence: Synthetic oligonucleotide
  Target: ANGPTL3; (+) strand; PAM type: NRG; PAM sequence: GAG
tattttaaaaggcatcatat

SEQ ID NO: 9683 - DNA, 20 bp, Artificial Sequence
  Description of Artificial Sequence: Synthetic oligonucleotide
  Target: ANGPTL3; (+) strand; PAM type: NRG; PAM sequence: CAG
agctaatatcacaactttcc

SEQ ID NO: 9684 - DNA, 20 bp, Artificial Sequence
  Description of Artificial Sequence: Synthetic oligonucleotide
  Target: ANGPTL3; (+) strand; PAM type: NRG; PAM sequence: TAG
actttcccagtttaaaaaac

SEQ ID NO: 9685 - DNA, 20 bp, Artificial Sequence
  Description of Artificial Sequence: Synthetic oligonucleotide
  Target: ANGPTL3; (+) strand; PAM type: NRG; PAM sequence: CAG
actctaaacttgactaaata

SEQ ID NO: 9686 - DNA, 20 bp, Artificial Sequence
  Description of Artificial Sequence: Synthetic oligonucleotide
  Target: ANGPTL3; (+) strand; PAM type: NRG; PAM sequence: GAG
tctaaacttgactaaataca

SEQ ID NO: 9687 - DNA, 20 bp, Artificial Sequence
  Description of Artificial Sequence: Synthetic oligonucleotide
  Target: ANGPTL3; (+) strand; PAM type: NRG; PAM sequence: AGG
ctaaacttgactaaatacag

SEQ ID NO: 9688 - DNA, 20 bp, Artificial Sequence
  Description of Artificial Sequence: Synthetic oligonucleotide
  Target: ANGPTL3; (+) strand; PAM type: NRG; PAM sequence: TGG
cttgactaaatacagaggac

SEQ ID NO: 9689 - DNA, 20 bp, Artificial Sequence
  Description of Artificial Sequence: Synthetic oligonucleotide
  Target: ANGPTL3; (+) strand; PAM type: NRG; PAM sequence: CAG
acagaggactggtaattgta

SEQ ID NO: 9690 - DNA, 20 bp, Artificial Sequence
  Description of Artificial Sequence: Synthetic oligonucleotide
  Target: ANGPTL3; (+) strand; PAM type: NRG; PAM sequence: TAG
tgtacagttcttaaatgttg

SEQ ID NO: 9691 - DNA, 20 bp, Artificial Sequence
  Description of Artificial Sequence: Synthetic oligonucleotide
  Target: ANGPTL3; (+) strand; PAM type: NRG; PAM sequence: CAG
atttcaaaactaaaaatcgt

SEQ ID NO: 9692 - DNA, 20 bp, Artificial Sequence
  Description of Artificial Sequence: Synthetic oligonucleotide
  Target: ANGPTL3; (+) strand; PAM type: NRG; PAM sequence: CAG
aaaactaaaaatcgtcagca

SEQ ID NO: 9693 - DNA, 20 bp, Artificial Sequence
  Description of Artificial Sequence: Synthetic oligonucleotide
  Target: ANGPTL3; (+) strand; PAM type: NRG; PAM sequence: GAG
aactaaaaatcgtcagcaca

SEQ ID NO: 9694 - DNA, 20 bp, Artificial Sequence
  Description of Artificial Sequence: Synthetic oligonucleotide
  Target: ANGPTL3; (+) strand; PAM type: NRG; PAM sequence: TGG
cattttgctacaaaataatt

SEQ ID NO: 9695 - DNA, 20 bp, Artificial Sequence
  Description of Artificial Sequence: Synthetic oligonucleotide
  Target: ANGPTL3; (+) strand; PAM type: NRG; PAM sequence: GAG
ttttgctacaaaataatttg

SEQ ID NO: 9696 - DNA, 20 bp, Artificial Sequence
  Description of Artificial Sequence: Synthetic oligonucleotide
  Target: ANGPTL3; (+) strand; PAM type: NRG; PAM sequence: AAG
tttatttatgaaacctaatg

SEQ ID NO: 9697 - DNA, 20 bp, Artificial Sequence
  Description of Artificial Sequence: Synthetic oligonucleotide
  Target: ANGPTL3; (+) strand; PAM type: NRG; PAM sequence: CAG
atttatgaaacctaatgaag

SEQ ID NO: 9698 - DNA, 20 bp, Artificial Sequence
  Description of Artificial Sequence: Synthetic oligonucleotide
  Target: ANGPTL3; (+) strand; PAM type: NRG; PAM sequence: AAG
attaaatactgtattaaaat

SEQ ID NO: 9699 - DNA, 20 bp, Artificial Sequence
  Description of Artificial Sequence: Synthetic oligonucleotide
  Target: ANGPTL3; (+) strand; PAM type: NRG; PAM sequence: TGG
gttcgctgtctttaaacaaa

SEQ ID NO: 9700 - DNA, 20 bp, Artificial Sequence
  Description of Artificial Sequence: Synthetic oligonucleotide
  Target: ANGPTL3; (+) strand; PAM type: NRG; PAM sequence: GAG
tcgctgtctttaaacaaatg

SEQ ID NO: 9701 - DNA, 20 bp, Artificial Sequence
  Description of Artificial Sequence: Synthetic oligonucleotide
  Target: ANGPTL3; (+) strand; PAM type: NRG; PAM sequence: AAG
aacaaatggagatgactact

SEQ ID NO: 9702 - DNA, 20 bp, Artificial Sequence
  Description of Artificial Sequence: Synthetic oligonucleotide
  Target: ANGPTL3; (+) strand; PAM type: NRG; PAM sequence: GAG
agtcacattgactttaacat

SEQ ID NO: 9703 - DNA, 20 bp, Artificial Sequence
  Description of Artificial Sequence: Synthetic oligonucleotide
  Target: ANGPTL3; (+) strand; PAM type: NRG; PAM sequence: AGG
gtcacattgactttaacatg

SEQ ID NO: 9704 - DNA, 20 bp, Artificial Sequence
  Description of Artificial Sequence: Synthetic oligonucleotide
  Target: ANGPTL3; (+) strand; PAM type: NRG; PAM sequence: AAG
tatgaaaacaaataattgta

SEQ ID NO: 9705 - DNA, 20 bp, Artificial Sequence
  Description of Artificial Sequence: Synthetic oligonucleotide
  Target: ANGPTL3; (+) strand; PAM type: NRG; PAM sequence: AGG
atgaaaacaaataattgtaa

SEQ ID NO: 9706 - DNA, 20 bp, Artificial Sequence
  Description of Artificial Sequence: Synthetic oligonucleotide
  Target: ANGPTL3; (+) strand; PAM type: NRG; PAM sequence: CAG
taattgtaaaggaatcttgt

SEQ ID NO: 9707 - DNA, 20 bp, Artificial Sequence
  Description of Artificial Sequence: Synthetic oligonucleotide
  Target: ANGPTL3; (+) strand; PAM type: NRG; PAM sequence: CAG
aaaggaatcttgtcagatta

SEQ ID NO: 9708 - DNA, 20 bp, Artificial Sequence
  Description of Artificial Sequence: Synthetic oligonucleotide
  Target: ANGPTL3; (+) strand; PAM type: NRG; PAM sequence: AAG
gaatcttgtcagattacagt

SEQ ID NO: 9709 - DNA, 20 bp, Artificial Sequence
  Description of Artificial Sequence: Synthetic oligonucleotide
  Target: ANGPTL3; (+) strand; PAM type: NRG; PAM sequence: TGG
agtaagaatgaacatatttg

SEQ ID NO: 9710 - DNA, 20 bp, Artificial Sequence
  Description of Artificial Sequence: Synthetic oligonucleotide
  Target: ANGPTL3; (+) strand; PAM type: NRG; PAM sequence: GAG
atgaacatatttgtggcatc

SEQ ID NO: 9711 - DNA, 20 bp, Artificial Sequence
  Description of Artificial Sequence: Synthetic oligonucleotide
  Target: ANGPTL3; (+) strand; PAM type: NRG; PAM sequence: AAG
atatttgtggcatcgagtta

SEQ ID NO: 9712 - DNA, 20 bp, Artificial Sequence
  Description of Artificial Sequence: Synthetic oligonucleotide
  Target: ANGPTL3; (+) strand; PAM type: NRG; PAM sequence: TAG
gtgattctaatacattcgtg

SEQ ID NO: 9713 - DNA, 20 bp, Artificial Sequence
  Description of Artificial Sequence: Synthetic oligonucleotide
  Target: ANGPTL3; (+) strand; PAM type: NRG; PAM sequence: AGG
tgattctaatacattcgtgt

SEQ ID NO: 9714 - DNA, 20 bp, Artificial Sequence
  Description of Artificial Sequence: Synthetic oligonucleotide
  Target: ANGPTL3; (+) strand; PAM type: NRG; PAM sequence: AAG
atacattcgtgtaggttttc

SEQ ID NO: 9715 - DNA, 20 bp, Artificial Sequence
  Description of Artificial Sequence: Synthetic oligonucleotide
  Target: ANGPTL3; (+) strand; PAM type: NRG; PAM sequence: TAG
cattcgtgtaggttttcaag

SEQ ID NO: 9716 - DNA, 20 bp, Artificial Sequence
  Description of Artificial Sequence: Synthetic oligonucleotide
  Target: ANGPTL3; (+) strand; PAM type: NRG; PAM sequence: AAG
gtagaaataaacctcgtaac

SEQ ID NO: 9717 - DNA, 20 bp, Artificial Sequence
  Description of Artificial Sequence: Synthetic oligonucleotide
  Target: ANGPTL3; (+) strand; PAM type: NRG; PAM sequence: CAG
caagttactgaacgtttaaa

SEQ ID NO: 9718 - DNA, 20 bp, Artificial Sequence
  Description of Artificial Sequence: Synthetic oligonucleotide
  Target: ANGPTL3; (+) strand; PAM type: NRG; PAM sequence: AAG
gaacgtttaaacagcctgac

SEQ ID NO: 9719 - DNA, 20 bp, Artificial Sequence
  Description of Artificial Sequence: Synthetic oligonucleotide
  Target: ANGPTL3; (+) strand; PAM type: NRG; PAM sequence: AAG
tgtttaaaattcaataaaca

SEQ ID NO: 9720 - DNA, 20 bp, Artificial Sequence
  Description of Artificial Sequence: Synthetic oligonucleotide
  Target: ANGPTL3; (+) strand; PAM type: NRG; PAM sequence: CAG
aaattcaataaacaaagacc

SEQ ID NO: 9721 - DNA, 20 bp, Artificial Sequence
  Description of Artificial Sequence: Synthetic oligonucleotide
  Target: ANGPTL3; (+) strand; PAM type: NRG; PAM sequence: TAG
aagacccagtccctaaatta

SEQ ID NO: 9722 - DNA, 20 bp, Artificial Sequence
  Description of Artificial Sequence: Synthetic oligonucleotide
  Target: ANGPTL3; (+) strand; PAM type: NRG; PAM sequence: CAG
catgtttatcgacatcacaa

SEQ ID NO: 9723 - DNA, 20 bp, Artificial Sequence
  Description of Artificial Sequence: Synthetic oligonucleotide
  Target: ANGPTL3; (+) strand; PAM type: NRG; PAM sequence: AAG
cctaaatccctaaatcccta

SEQ ID NO: 9724 - DNA, 20 bp, Artificial Sequence
  Description of Artificial Sequence: Synthetic oligonucleotide
  Target: ANGPTL3; (+) strand; PAM type: NRG; PAM sequence: TAG
atccctaaatccctaaagat

SEQ ID NO: 9725 - DNA, 20 bp, Artificial Sequence
  Description of Artificial Sequence: Synthetic oligonucleotide
  Target: ANGPTL3; (+) strand; PAM type: NRG; PAM sequence: CAG
tagatacaaattttttacca

SEQ ID NO: 9726 - DNA, 20 bp, Artificial Sequence
  Description of Artificial Sequence: Synthetic oligonucleotide
  Target: ANGPTL3; (+) strand; PAM type: NRG; PAM sequence: CAG
tttaccacagtatcacttgt

SEQ ID NO: 9727 - DNA, 20 bp, Artificial Sequence
  Description of Artificial Sequence: Synthetic oligonucleotide
  Target: ANGPTL3; (+) strand; PAM type: NRG; PAM sequence: CAG
atatgattttttaaaactgc

SEQ ID NO: 9728 - DNA, 20 bp, Artificial Sequence
  Description of Artificial Sequence: Synthetic oligonucleotide
  Target: ANGPTL3; (+) strand; PAM type: NRG; PAM sequence: AAG
gattttttaaaactgccagt

SEQ ID NO: 9729 - DNA, 20 bp, Artificial Sequence
  Description of Artificial Sequence: Synthetic oligonucleotide
  Target: ANGPTL3; (+) strand; PAM type: NRG; PAM sequence: AAG
taaattaaacccatttgtta

SEQ ID NO: 9730 - DNA, 20 bp, Artificial Sequence
  Description of Artificial Sequence: Synthetic oligonucleotide
  Target: ANGPTL3; (+) strand; PAM type: NRG; PAM sequence: AGG
aaattaaacccatttgttaa

SEQ ID NO: 9731 - DNA, 20 bp, Artificial Sequence
  Description of Artificial Sequence: Synthetic oligonucleotide
  Target: ANGPTL3; (+) strand; PAM type: NRG; PAM sequence: TAG
aacccatttgttaaaggata

SEQ ID NO: 9732 - DNA, 20 bp, Artificial Sequence
  Description of Artificial Sequence: Synthetic oligonucleotide
  Target: ANGPTL3; (+) strand; PAM type: NRG; PAM sequence: AAG
tgttaaaggatatagtgccc

SEQ ID NO: 9733 - DNA, 20 bp, Artificial Sequence
  Description of Artificial Sequence: Synthetic oligonucleotide
  Target: ANGPTL3; (+) strand; PAM type: NRG; PAM sequence: TGG
gatatagtgcccaagttata

SEQ ID NO: 9734 - DNA, 20 bp, Artificial Sequence
  Description of Artificial Sequence: Synthetic oligonucleotide
  Target: ANGPTL3; (+) strand; PAM type: NRG; PAM sequence: TAG
gacctacctttgtcaatact

SEQ ID NO: 9735 - DNA, 20 bp, Artificial Sequence
  Description of Artificial Sequence: Synthetic oligonucleotide
  Target: ANGPTL3; (+) strand; PAM type: NRG; PAM sequence: AAG
tttatatgtcacatatataa

SEQ ID NO: 9736 - DNA, 20 bp, Artificial Sequence
  Description of Artificial Sequence: Synthetic oligonucleotide
  Target: ANGPTL3; (+) strand; PAM type: NRG; PAM sequence: AAG
gtatgatctatgtgaatcct

SEQ ID NO: 9737 - DNA, 20 bp, Artificial Sequence
  Description of Artificial Sequence: Synthetic oligonucleotide
  Target: ANGPTL3; (+) strand; PAM type: NRG; PAM sequence: CAG
cctaagtaaatattttgttc

SEQ ID NO: 9738 - DNA, 20 bp, Artificial Sequence
  Description of Artificial Sequence: Synthetic oligonucleotide
  Target: ANGPTL3; (+) strand; PAM type: NRG; PAM sequence: AAG
gtaaatattttgttccagaa

SEQ ID NO: 9739 - DNA, 20 bp, Artificial Sequence
  Description of Artificial Sequence: Synthetic oligonucleotide
  Target: ANGPTL3; (+) strand; PAM type: NRG; PAM sequence: AAG
cagaaaagtacaaaataata

SEQ ID NO: 9740 - DNA, 20 bp, Artificial Sequence
  Description of Artificial Sequence: Synthetic oligonucleotide
  Target: ANGPTL3; (+) strand; PAM type: NRG; PAM sequence: AGG
agaaaagtacaaaataataa

SEQ ID NO: 9741 - DNA, 20 bp, Artificial Sequence
  Description of Artificial Sequence: Synthetic oligonucleotide
  Target: ANGPTL3; (+) strand; PAM type: NRG; PAM sequence: CAG
taaaaataatctataatttt

SEQ ID NO: 9742 - DNA, 20 bp, Artificial Sequence
  Description of Artificial Sequence: Synthetic oligonucleotide
  Target: ANGPTL3; (+) strand; PAM type: NRG; PAM sequence: AGG
aaaaataatctataattttc

SEQ ID NO: 9743 - DNA, 20 bp, Artificial Sequence
  Description of Artificial Sequence: Synthetic oligonucleotide
  Target: ANGPTL3; (+) strand; PAM type: NRG; PAM sequence: CAG
atctataattttcaggacca

SEQ ID NO: 9744 - DNA, 20 bp, Artificial Sequence
  Description of Artificial Sequence: Synthetic oligonucleotide
  Target: ANGPTL3; (+) strand; PAM type: NRG; PAM sequence: AAG
aattttcaggaccacagact

SEQ ID NO: 9745 - DNA, 20 bp, Artificial Sequence
  Description of Artificial Sequence: Synthetic oligonucleotide
  Target: ANGPTL3; (+) strand; PAM type: NRG; PAM sequence: TAG
gaaattaacgctgatttttt

SEQ ID NO: 9746 - DNA, 20 bp, Artificial Sequence
  Description of Artificial Sequence: Synthetic oligonucleotide
  Target: ANGPTL3; (+) strand; PAM type: NRG; PAM sequence: AGG
aaattaacgctgattttttt

SEQ ID NO: 9747 - DNA, 20 bp, Artificial Sequence
  Description of Artificial Sequence: Synthetic oligonucleotide
  Target: ANGPTL3; (+) strand; PAM type: NRG; PAM sequence: GGG
aattaacgctgattttttta

SEQ ID NO: 9748 - DNA, 20 bp, Artificial Sequence
  Description of Artificial Sequence: Synthetic oligonucleotide
  Target: ANGPTL3; (+) strand; PAM type: NRG; PAM sequence: CAG
aacgctgatttttttagggc

SEQ ID NO: 9749 - DNA, 20 bp, Artificial Sequence
  Description of Artificial Sequence: Synthetic oligonucleotide
  Target: ANGPTL3; (+) strand; PAM type: NRG; PAM sequence: TGG
ttagggccagaataccaaaa

SEQ ID NO: 9750 - DNA, 20 bp, Artificial Sequence
  Description of Artificial Sequence: Synthetic oligonucleotide
  Target: ANGPTL3; (+) strand; PAM type: NRG; PAM sequence: TGG
ctcctctcttcccccaaaat

SEQ ID NO: 9751 - DNA, 20 bp, Artificial Sequence
  Description of Artificial Sequence: Synthetic oligonucleotide
  Target: ANGPTL3; (+) strand; PAM type: NRG; PAM sequence: GAG
taattcattatttaatatat

SEQ ID NO: 9752 - DNA, 20 bp, Artificial Sequence
  Description of Artificial Sequence: Synthetic oligonucleotide
  Target: ANGPTL3; (+) strand; PAM type: NRG; PAM sequence: TGG
tatgagttgcttcctctatt

SEQ ID NO: 9753 - DNA, 20 bp, Artificial Sequence
  Description of Artificial Sequence: Synthetic oligonucleotide
  Target: ANGPTL3; (+) strand; PAM type: NRG; PAM sequence: TAG
aaaaaaaaaaaaaactctca

SEQ ID NO: 9754 - DNA, 20 bp, Artificial Sequence
  Description of Artificial Sequence: Synthetic oligonucleotide
  Target: ANGPTL3; (+) strand; PAM type: NRG; PAM sequence: AGG
aaaaaaaaaaaaactctcat

SEQ ID NO: 9755 - DNA, 20 bp, Artificial Sequence
  Description of Artificial Sequence: Synthetic oligonucleotide
  Target: ANGPTL3; (+) strand; PAM type: NRG; PAM sequence: CAG
atgtttcattttgttccttt

SEQ ID NO: 9756 - DNA, 20 bp, Artificial Sequence
  Description of Artificial Sequence: Synthetic oligonucleotide
  Target: ANGPTL3; (+) strand; PAM type: NRG; PAM sequence: AGG
tgtttcattttgttcctttc

SEQ ID NO: 9757 - DNA, 20 bp, Artificial Sequence
  Description of Artificial Sequence: Synthetic oligonucleotide
  Target: ANGPTL3; (+) strand; PAM type: NRG; PAM sequence: GAG
tttcattttgttcctttcag

SEQ ID NO: 9758 - DNA, 20 bp, Artificial Sequence
  Description of Artificial Sequence: Synthetic oligonucleotide
  Target: ANGPTL3; (+) strand; PAM type: NRG; PAM sequence: TAG
cattttgttcctttcaggag

SEQ ID NO: 9759 - DNA, 20 bp, Artificial Sequence
  Description of Artificial Sequence: Synthetic oligonucleotide
  Target: ANGPTL3; (+) strand; PAM type: NRG; PAM sequence: TAG
tcctttcaggagtagtaaat

SEQ ID NO: 9760 - DNA, 20 bp, Artificial Sequence
  Description of Artificial Sequence: Synthetic oligonucleotide
  Target: ANGPTL3; (+) strand; PAM type: NRG; PAM sequence: AAG
ttagacgttttccccatata

SEQ ID NO: 9761 - DNA, 20 bp, Artificial Sequence
  Description of Artificial Sequence: Synthetic oligonucleotide
  Target: ANGPTL3; (+) strand; PAM type: NRG; PAM sequence: CAG
catataaagcttttttctac

SEQ ID NO: 9762 - DNA, 20 bp, Artificial Sequence
  Description of Artificial Sequence: Synthetic oligonucleotide
  Target: ANGPTL3; (+) strand; PAM type: NRG; PAM sequence: AAG
taaagcttttttctaccaga

SEQ ID NO: 9763 - DNA, 20 bp, Artificial Sequence
  Description of Artificial Sequence: Synthetic oligonucleotide
  Target: ANGPTL3; (+) strand; PAM type: NRG; PAM sequence: TGG
ttctaccagaaagatacttc

SEQ ID NO: 9764 - DNA, 20 bp, Artificial Sequence
  Description of Artificial Sequence: Synthetic oligonucleotide
  Target: ANGPTL3; (+) strand; PAM type: NRG; PAM sequence: TAG
taccagaaagatacttctgg

SEQ ID NO: 9765 - DNA, 20 bp, Artificial Sequence
  Description of Artificial Sequence: Synthetic oligonucleotide
  Target: ANGPTL3; (+) strand; PAM type: NRG; PAM sequence: AAG
cagaaagatacttctggtag

SEQ ID NO: 9766 - DNA, 20 bp, Artificial Sequence
  Description of Artificial Sequence: Synthetic oligonucleotide
  Target: ANGPTL3; (+) strand; PAM type: NRG; PAM sequence: AAG
aaagatacttctggtagaag

SEQ ID NO: 9767 - DNA, 20 bp, Artificial Sequence
  Description of Artificial Sequence: Synthetic oligonucleotide
  Target: ANGPTL3; (+) strand; PAM type: NRG; PAM sequence: GAG
agatacttctggtagaagaa

SEQ ID NO: 9768 - DNA, 20 bp, Artificial Sequence
  Description of Artificial Sequence: Synthetic oligonucleotide
  Target: ANGPTL3; (+) strand; PAM type: NRG; PAM sequence: AAG
acttctggtagaagaagaga

SEQ ID NO: 9769 - DNA, 20 bp, Artificial Sequence
  Description of Artificial Sequence: Synthetic oligonucleotide
  Target: ANGPTL3; (+) strand; PAM type: NRG; PAM sequence: AGG
cttctggtagaagaagagaa

SEQ ID NO: 9770 - DNA, 20 bp, Artificial Sequence
  Description of Artificial Sequence: Synthetic oligonucleotide
  Target: ANGPTL3; (+) strand; PAM type: NRG; PAM sequence: GAG
tctggtagaagaagagaaag

SEQ ID NO: 9771 - DNA, 20 bp, Artificial Sequence
  Description of Artificial Sequence: Synthetic oligonucleotide
  Target: ANGPTL3; (+) strand; PAM type: NRG; PAM sequence: TGG
gaagagaaaggagctcttta

SEQ ID NO: 9772 - DNA, 20 bp, Artificial Sequence
  Description of Artificial Sequence: Synthetic oligonucleotide
  Target: ANGPTL3; (+) strand; PAM type: NRG; PAM sequence: AAG
tgtcctaactactttgctta

SEQ ID NO: 9773 - DNA, 20 bp, Artificial Sequence
  Description of Artificial Sequence: Synthetic oligonucleotide
  Target: ANGPTL3; (+) strand; PAM type: NRG; PAM sequence: CAG
tcaaattccatcactactca

SEQ ID NO: 9774 - DNA, 20 bp, Artificial Sequence
  Description of Artificial Sequence: Synthetic oligonucleotide
  Target: ANGPTL3; (+) strand; PAM type: NRG; PAM sequence: AAG
tactcacagttgtctaatct

SEQ ID NO: 9775 - DNA, 20 bp, Artificial Sequence
  Description of Artificial Sequence: Synthetic oligonucleotide
  Target: ANGPTL3; (+) strand; PAM type: NRG; PAM sequence: CAG
tctaatcccctttgatctct

SEQ ID NO: 9776 - DNA, 20 bp, Artificial Sequence
  Description of Artificial Sequence: Synthetic oligonucleotide
  Target: ANGPTL3; (+) strand; PAM type: NRG; PAM sequence: AAG
tctctctactacttaataat

SEQ ID NO: 9777 - DNA, 20 bp, Artificial Sequence
  Description of Artificial Sequence: Synthetic oligonucleotide
  Target: ANGPTL3; (+) strand; PAM type: NRG; PAM sequence: TGG
tcacaatactatactctcca

SEQ ID NO: 9778 - DNA, 20 bp, Artificial Sequence
  Description of Artificial Sequence: Synthetic oligonucleotide
  Target: ANGPTL3; (+) strand; PAM type: NRG; PAM sequence: TAG
ccctattcctttctcatatt

SEQ ID NO: 9779 - DNA, 20 bp, Artificial Sequence
  Description of Artificial Sequence: Synthetic oligonucleotide
  Target: ANGPTL3; (+) strand; PAM type: NRG; PAM sequence: TGG
ctttctcatatttagtactg

SEQ ID NO: 9780 - DNA, 20 bp, Artificial Sequence
  Description of Artificial Sequence: Synthetic oligonucleotide
  Target: ANGPTL3; (+) strand; PAM type: NRG; PAM sequence: GGG
tttctcatatttagtactgt

SEQ ID NO: 9781 - DNA, 20 bp, Artificial Sequence
  Description of Artificial Sequence: Synthetic oligonucleotide
  Target: ANGPTL3; (+) strand; PAM type: NRG; PAM sequence: TGG
tatttagtactgtgggccaa

SEQ ID NO: 9782 - DNA, 20 bp, Artificial Sequence
  Description of Artificial Sequence: Synthetic oligonucleotide
  Target: ANGPTL3; (+) strand; PAM type: NRG; PAM sequence: CAG
atcttttctacactgaccct

SEQ ID NO: 9783 - DNA, 20 bp, Artificial Sequence
  Description of Artificial Sequence: Synthetic oligonucleotide
  Target: ANGPTL3; (+) strand; PAM type: NRG; PAM sequence: CGG
agacattctatctgctctca

SEQ ID NO: 9784 - DNA, 20 bp, Artificial Sequence
  Description of Artificial Sequence: Synthetic oligonucleotide
  Target: ANGPTL3; (+) strand; PAM type: NRG; PAM sequence: AAG
tcctttatttaccatgaata

SEQ ID NO: 9785 - DNA, 20 bp, Artificial Sequence
  Description of Artificial Sequence: Synthetic oligonucleotide
  Target: ANGPTL3; (+) strand; PAM type: NRG; PAM sequence: AAG
aaaatctacatattcatccc

SEQ ID NO: 9786 - DNA, 20 bp, Artificial Sequence
  Description of Artificial Sequence: Synthetic oligonucleotide
  Target: ANGPTL3; (+) strand; PAM type: NRG; PAM sequence: CAG
attcatcccaagtctctttc

SEQ ID NO: 9787 - DNA, 20 bp, Artificial Sequence
  Description of Artificial Sequence: Synthetic oligonucleotide
  Target: ANGPTL3; (+) strand; PAM type: NRG; PAM sequence: AAG
attcaacataccaaaaataa

SEQ ID NO: 9788 - DNA, 20 bp, Artificial Sequence
  Description of Artificial Sequence: Synthetic oligonucleotide
  Target: ANGPTL3; (+) strand; PAM type: NRG; PAM sequence: AGG
ttcaacataccaaaaataaa

SEQ ID NO: 9789 - DNA, 20 bp, Artificial Sequence
  Description of Artificial Sequence: Synthetic oligonucleotide
  Target: ANGPTL3; (+) strand; PAM type: NRG; PAM sequence: CAG
acataccaaaaataaaaggc

SEQ ID NO: 9790 - DNA, 20 bp, Artificial Sequence
  Description of Artificial Sequence: Synthetic oligonucleotide
  Target: ANGPTL3; (+) strand; PAM type: NRG; PAM sequence: AGG
cataccaaaaataaaaggcc

SEQ ID NO: 9791 - DNA, 20 bp, Artificial Sequence
  Description of Artificial Sequence: Synthetic oligonucleotide
  Target: ANGPTL3; (+) strand; PAM type: NRG; PAM sequence: CGG
caaaaataaaaggccaggca

SEQ ID NO: 9792 - DNA, 20 bp, Artificial Sequence
  Description of Artificial Sequence: Synthetic oligonucleotide
  Target: ANGPTL3; (+) strand; PAM type: NRG; PAM sequence: TGG
aaataaaaggccaggcacgg

SEQ ID NO: 9793 - DNA, 20 bp, Artificial Sequence
  Description of Artificial Sequence: Synthetic oligonucleotide
  Target: ANGPTL3; (+) strand; PAM type: NRG; PAM sequence: CAG
gtggctcacacctgtaatcc

SEQ ID NO: 9794 - DNA, 20 bp, Artificial Sequence
  Description of Artificial Sequence: Synthetic oligonucleotide
  Target: ANGPTL3; (+) strand; PAM type: NRG; PAM sequence: AGG
tggctcacacctgtaatccc

SEQ ID NO: 9795 - DNA, 20 bp, Artificial Sequence
  Description of Artificial Sequence: Synthetic oligonucleotide
  Target: ANGPTL3; (+) strand; PAM type: NRG; PAM sequence: TGG
cacctgtaatcccaggactt

SEQ ID NO: 9796 - DNA, 20 bp, Artificial Sequence
  Description of Artificial Sequence: Synthetic oligonucleotide
  Target: ANGPTL3; (+) strand; PAM type: NRG; PAM sequence: GGG
acctgtaatcccaggacttt

SEQ ID NO: 9797 - DNA, 20 bp, Artificial Sequence
  Description of Artificial Sequence: Synthetic oligonucleotide
  Target: ANGPTL3; (+) strand; PAM type: NRG; PAM sequence: GAG
ctgtaatcccaggactttgg

SEQ ID NO: 9798 - DNA, 20 bp, Artificial Sequence
  Description of Artificial Sequence: Synthetic oligonucleotide
  Target: ANGPTL3; (+) strand; PAM type: NRG; PAM sequence: AGG
tgtaatcccaggactttggg

SEQ ID NO: 9799 - DNA, 20 bp, Artificial Sequence
  Description of Artificial Sequence: Synthetic oligonucleotide
  Target: ANGPTL3; (+) strand; PAM type: NRG; PAM sequence: GAG
tcccaggactttgggaggct

SEQ ID NO: 9800 - DNA, 20 bp, Artificial Sequence
  Description of Artificial Sequence: Synthetic oligonucleotide
  Target: ANGPTL3; (+) strand; PAM type: NRG; PAM sequence: AGG
cccaggactttgggaggctg

SEQ ID NO: 9801 - DNA, 20 bp, Artificial Sequence
  Description of Artificial Sequence: Synthetic oligonucleotide
  Target: ANGPTL3; (+) strand; PAM type: NRG; PAM sequence: CAG
aggactttgggaggctgagg

SEQ ID NO: 9802 - DNA, 20 bp, Artificial Sequence
  Description of Artificial Sequence: Synthetic oligonucleotide
  Target: ANGPTL3; (+) strand; PAM type: NRG; PAM sequence: AGG
ggactttgggaggctgaggc

SEQ ID NO: 9803 - DNA, 20 bp, Artificial Sequence
  Description of Artificial Sequence: Synthetic oligonucleotide
  Target: ANGPTL3; (+) strand; PAM type: NRG; PAM sequence: TGG
ctttgggaggctgaggcagg

SEQ ID NO: 9804 - DNA, 20 bp, Artificial Sequence
  Description of Artificial Sequence: Synthetic oligonucleotide
  Target: ANGPTL3; (+) strand; PAM type: NRG; PAM sequence: GAG
ctgaggcaggtggatcacct

SEQ ID NO: 9805 - DNA, 20 bp, Artificial Sequence
  Description of Artificial Sequence: Synthetic oligonucleotide
  Target: ANGPTL3; (+) strand; PAM type: NRG; PAM sequence: AGG
tgaggcaggtggatcacctg

SEQ ID NO: 9806 - DNA, 20 bp, Artificial Sequence
  Description of Artificial Sequence: Synthetic oligonucleotide
  Target: ANGPTL3; (+) strand; PAM type: NRG; PAM sequence: CAG
gcaggtggatcacctgaggt

SEQ ID NO: 9807 - DNA, 20 bp, Artificial Sequence
  Description of Artificial Sequence: Synthetic oligonucleotide
  Target: ANGPTL3; (+) strand; PAM type: NRG; PAM sequence: AGG
caggtggatcacctgaggtc

SEQ ID NO: 9808 - DNA, 20 bp, Artificial Sequence
  Description of Artificial Sequence: Synthetic oligonucleotide
  Target: ANGPTL3; (+) strand; PAM type: NRG; PAM sequence: GAG
ggtggatcacctgaggtcag

SEQ ID NO: 9809 - DNA, 20 bp, Artificial Sequence
  Description of Artificial Sequence: Synthetic oligonucleotide
  Target: ANGPTL3; (+) strand; PAM type: NRG; PAM sequence: CAG
cctgaggtcaggagtctgac

SEQ ID NO: 9810 - DNA, 20 bp, Artificial Sequence
  Description of Artificial Sequence: Synthetic oligonucleotide
  Target: ANGPTL3; (+) strand; PAM type: NRG; PAM sequence: TGG
tctgaccagcctgaccaata

SEQ ID NO: 9811 - DNA, 20 bp, Artificial Sequence
  Description of Artificial Sequence: Synthetic oligonucleotide
  Target: ANGPTL3; (+) strand; PAM type: NRG; PAM sequence: TAG
tctacctaaaatacaaaaat

SEQ ID NO: 9812 - DNA, 20 bp, Artificial Sequence
  Description of Artificial Sequence: Synthetic oligonucleotide
  Target: ANGPTL3; (+) strand; PAM type: NRG; PAM sequence: CAG
cctaaaatacaaaaattagc

SEQ ID NO: 9813 - DNA, 20 bp, Artificial Sequence
  Description of Artificial Sequence: Synthetic oligonucleotide
  Target: ANGPTL3; (+) strand; PAM type: NRG; PAM sequence: AGG
ctaaaatacaaaaattagcc

SEQ ID NO: 9814 - DNA, 20 bp, Artificial Sequence
  Description of Artificial Sequence: Synthetic oligonucleotide
  Target: ANGPTL3; (+) strand; PAM type: NRG; PAM sequence: TGG
atacaaaaattagccaggcg

SEQ ID NO: 9815 - DNA, 20 bp, Artificial Sequence
  Description of Artificial Sequence: Synthetic oligonucleotide
  Target: ANGPTL3; (+) strand; PAM type: NRG; PAM sequence: TGG
caaaaattagccaggcgtgg

SEQ ID NO: 9816 - DNA, 20 bp, Artificial Sequence
  Description of Artificial Sequence: Synthetic oligonucleotide
  Target: ANGPTL3; (+) strand; PAM type: NRG; PAM sequence: CAG
ggcgtggtggcatgtgccta

SEQ ID NO: 9817 - DNA, 20 bp, Artificial Sequence
  Description of Artificial Sequence: Synthetic oligonucleotide
  Target: ANGPTL3; (+) strand; PAM type: NRG; PAM sequence: CAG
gtggcatgtgcctacagtcc

SEQ ID NO: 9818 - DNA, 20 bp, Artificial Sequence
  Description of Artificial Sequence: Synthetic oligonucleotide
  Target: ANGPTL3; (+) strand; PAM type: NRG; PAM sequence: AAG
gcctacagtcccagctactc

SEQ ID NO: 9819 - DNA, 20 bp, Artificial Sequence
  Description of Artificial Sequence: Synthetic oligonucleotide
  Target: ANGPTL3; (+) strand; PAM type: NRG; PAM sequence: GAG
ctacagtcccagctactcaa

SEQ ID NO: 9820 - DNA, 20 bp, Artificial Sequence
  Description of Artificial Sequence: Synthetic oligonucleotide
  Target: ANGPTL3; (+) strand; PAM type: NRG; PAM sequence: AGG
tacagtcccagctactcaag

SEQ ID NO: 9821 - DNA, 20 bp, Artificial Sequence
  Description of Artificial Sequence: Synthetic oligonucleotide
  Target: ANGPTL3; (+) strand; PAM type: NRG; PAM sequence: GAG
tcccagctactcaagaggct

SEQ ID NO: 9822 - DNA, 20 bp, Artificial Sequence
  Description of Artificial Sequence: Synthetic oligonucleotide
  Target: ANGPTL3; (+) strand; PAM type: NRG; PAM sequence: CAG
agctactcaagaggctgaga

SEQ ID NO: 9823 - DNA, 20 bp, Artificial Sequence
  Description of Artificial Sequence: Synthetic oligonucleotide
  Target: ANGPTL3; (+) strand; PAM type: NRG; PAM sequence: AGG
gctactcaagaggctgagac

SEQ ID NO: 9824 - DNA, 20 bp, Artificial Sequence
  Description of Artificial Sequence: Synthetic oligonucleotide
  Target: ANGPTL3; (+) strand; PAM type: NRG; PAM sequence: GAG
tactcaagaggctgagacag

SEQ ID NO: 9825 - DNA, 20 bp, Artificial Sequence
  Description of Artificial Sequence: Synthetic oligonucleotide
  Target: ANGPTL3; (+) strand; PAM type: NRG; PAM sequence: CAG
acaggagaatcgcttgaacc

SEQ ID NO: 9826 - DNA, 20 bp, Artificial Sequence
  Description of Artificial Sequence: Synthetic oligonucleotide
  Target: ANGPTL3; (+) strand; PAM type: NRG; PAM sequence: AGG
caggagaatcgcttgaaccc

SEQ ID NO: 9827 - DNA, 20 bp, Artificial Sequence
  Description of Artificial Sequence: Synthetic oligonucleotide
  Target: ANGPTL3; (+) strand; PAM type: NRG; PAM sequence: GAG
ggagaatcgcttgaacccag

SEQ ID NO: 9828 - DNA, 20 bp, Artificial Sequence
  Description of Artificial Sequence: Synthetic oligonucleotide
  Target: ANGPTL3; (+) strand; PAM type: NRG; PAM sequence: AGG
gagaatcgcttgaacccagg

SEQ ID NO: 9829 - DNA, 20 bp, Artificial Sequence
  Description of Artificial Sequence: Synthetic oligonucleotide
  Target: ANGPTL3; (+) strand; PAM type: NRG; PAM sequence: CGG
aatcgcttgaacccaggagg

SEQ ID NO: 9830 - DNA, 20 bp, Artificial Sequence
  Description of Artificial Sequence: Synthetic oligonucleotide
  Target: ANGPTL3; (+) strand; PAM type: NRG; PAM sequence: GAG
tcgcttgaacccaggaggcg

SEQ ID NO: 9831 - DNA, 20 bp, Artificial Sequence
  Description of Artificial Sequence: Synthetic oligonucleotide
  Target: ANGPTL3; (+) strand; PAM type: NRG; PAM sequence: AGG
cgcttgaacccaggaggcgg

SEQ ID NO: 9832 - DNA, 20 bp, Artificial Sequence
  Description of Artificial Sequence: Synthetic oligonucleotide
  Target: ANGPTL3; (+) strand; PAM type: NRG; PAM sequence: CAG
aacccaggaggcggaggttg

SEQ ID NO: 9833 - DNA, 20 bp, Artificial Sequence
  Description of Artificial Sequence: Synthetic oligonucleotide
  Target: ANGPTL3; (+) strand; PAM type: NRG; PAM sequence: GAG
caggaggcggaggttgcagt

SEQ ID NO: 9834 - DNA, 20 bp, Artificial Sequence
  Description of Artificial Sequence: Synthetic oligonucleotide
  Target: ANGPTL3; (+) strand; PAM type: NRG; PAM sequence: GAG
ggcggaggttgcagtgagct

SEQ ID NO: 9835 - DNA, 20 bp, Artificial Sequence
  Description of Artificial Sequence: Synthetic oligonucleotide
  Target: ANGPTL3; (+) strand; PAM type: NRG; PAM sequence: TGG
ctgagatcacaccaatgcac

SEQ ID NO: 9836 - DNA, 20 bp, Artificial Sequence
  Description of Artificial Sequence: Synthetic oligonucleotide
  Target: ANGPTL3; (+) strand; PAM type: NRG; PAM sequence: GGG
tgagatcacaccaatgcact

SEQ ID NO: 9837 - DNA, 20 bp, Artificial Sequence
  Description of Artificial Sequence: Synthetic oligonucleotide
  Target: ANGPTL3; (+) strand; PAM type: NRG; PAM sequence: CAG
cacaccaatgcactgggtga

SEQ ID NO: 9838 - DNA, 20 bp, Artificial Sequence
  Description of Artificial Sequence: Synthetic oligonucleotide
  Target: ANGPTL3; (+) strand; PAM type: NRG; PAM sequence: AAG
aatgcactgggtgacagaac

SEQ ID NO: 9839 - DNA, 20 bp, Artificial Sequence
  Description of Artificial Sequence: Synthetic oligonucleotide
  Target: ANGPTL3; (+) strand; PAM type: NRG; PAM sequence: CAG
aaaataaataacaaattccc

SEQ ID NO: 9840 - DNA, 20 bp, Artificial Sequence
  Description of Artificial Sequence: Synthetic oligonucleotide
  Target: ANGPTL3; (+) strand; PAM type: NRG; PAM sequence: CAG
tttatatccattaatatgac

SEQ ID NO: 9841 - DNA, 20 bp, Artificial Sequence
  Description of Artificial Sequence: Synthetic oligonucleotide
  Target: ANGPTL3; (+) strand; PAM type: NRG; PAM sequence: CAG
taatatgaccagcatgttcc

SEQ ID NO: 9842 - DNA, 20 bp, Artificial Sequence
  Description of Artificial Sequence: Synthetic oligonucleotide
  Target: ANGPTL3; (+) strand; PAM type: NRG; PAM sequence: CAG
gaccagcatgttcccagtca

SEQ ID NO: 9843 - DNA, 20 bp, Artificial Sequence
  Description of Artificial Sequence: Synthetic oligonucleotide
  Target: ANGPTL3; (+) strand; PAM type: NRG; PAM sequence: AAG
cagcatgttcccagtcacag

SEQ ID NO: 9844 - DNA, 20 bp, Artificial Sequence
  Description of Artificial Sequence: Synthetic oligonucleotide
  Target: ANGPTL3; (+) strand; PAM type: NRG; PAM sequence: TGG
tgttcccagtcacagaagcc

SEQ ID NO: 9845 - DNA, 20 bp, Artificial Sequence
  Description of Artificial Sequence: Synthetic oligonucleotide
  Target: ANGPTL3; (+) strand; PAM type: NRG; PAM sequence: CGG
agtcacagaagcctggaacc

SEQ ID NO: 9846 - DNA, 20 bp, Artificial Sequence
  Description of Artificial Sequence: Synthetic oligonucleotide
  Target: ANGPTL3; (+) strand; PAM type: NRG; PAM sequence: AAG
cacagaagcctggaacccgg

SEQ ID NO: 9847 - DNA, 20 bp, Artificial Sequence
  Description of Artificial Sequence: Synthetic oligonucleotide
  Target: ANGPTL3; (+) strand; PAM type: NRG; PAM sequence: TGG
tggaacccggaagacatctc

SEQ ID NO: 9848 - DNA, 20 bp, Artificial Sequence
  Description of Artificial Sequence: Synthetic oligonucleotide
  Target: ANGPTL3; (+) strand; PAM type: NRG; PAM sequence: AAG
aactacctcttttgtatcat

SEQ ID NO: 9849 - DNA, 20 bp, Artificial Sequence
  Description of Artificial Sequence: Synthetic oligonucleotide
  Target: ANGPTL3; (+) strand; PAM type: NRG; PAM sequence: AAG
cttttgtatcataagccacc

SEQ ID NO: 9850 - DNA, 20 bp, Artificial Sequence
  Description of Artificial Sequence: Synthetic oligonucleotide
  Target: ANGPTL3; (+) strand; PAM type: NRG; PAM sequence: AAG
gaaacgtctcttaatcttat

SEQ ID NO: 9851 - DNA, 20 bp, Artificial Sequence
  Description of Artificial Sequence: Synthetic oligonucleotide
  Target: ANGPTL3; (+) strand; PAM type: NRG; PAM sequence: AAG
cttataagctttcttcccca

SEQ ID NO: 9852 - DNA, 20 bp, Artificial Sequence
  Description of Artificial Sequence: Synthetic oligonucleotide
  Target: ANGPTL3; (+) strand; PAM type: NRG; PAM sequence: CAG
ccaaagactgtctttaactt

SEQ ID NO: 9853 - DNA, 20 bp, Artificial Sequence
  Description of Artificial Sequence: Synthetic oligonucleotide
  Target: ANGPTL3; (+) strand; PAM type: NRG; PAM sequence: TAG
actgtctttaacttcagtgc

SEQ ID NO: 9854 - DNA, 20 bp, Artificial Sequence
  Description of Artificial Sequence: Synthetic oligonucleotide
  Target: ANGPTL3; (+) strand; PAM type: NRG; PAM sequence: AAG
acttcagtgctagattatat

SEQ ID NO: 9855 - DNA, 20 bp, Artificial Sequence
  Description of Artificial Sequence: Synthetic oligonucleotide
  Target: ANGPTL3; (+) strand; PAM type: NRG; PAM sequence: TAG
tcagtgctagattatataag

SEQ ID NO: 9856 - DNA, 20 bp, Artificial Sequence
  Description of Artificial Sequence: Synthetic oligonucleotide
  Target: ANGPTL3; (+) strand; PAM type: NRG; PAM sequence: AAG
ctccctgtcaatcttccgaa

SEQ ID NO: 9857 - DNA, 20 bp, Artificial Sequence
  Description of Artificial Sequence: Synthetic oligonucleotide
  Target: ANGPTL3; (+) strand; PAM type: NRG; PAM sequence: AGG
tccctgtcaatcttccgaaa

SEQ ID NO: 9858 - DNA, 20 bp, Artificial Sequence
  Description of Artificial Sequence: Synthetic oligonucleotide
  Target: ANGPTL3; (+) strand; PAM type: NRG; PAM sequence: TGG
ttccgaaaaggaatttgtaa

SEQ ID NO: 9859 - DNA, 20 bp, Artificial Sequence
  Description of Artificial Sequence: Synthetic oligonucleotide
  Target: ANGPTL3; (+) strand; PAM type: NRG; PAM sequence: TGG
tgtaatggctgcatactgcc

SEQ ID NO: 9860 - DNA, 20 bp, Artificial Sequence
  Description of Artificial Sequence: Synthetic oligonucleotide
  Target: ANGPTL3; (+) strand; PAM type: NRG; PAM sequence: AAG
tgcctggacctgtgtctttc

SEQ ID NO: 9861 - DNA, 20 bp, Artificial Sequence
  Description of Artificial Sequence: Synthetic oligonucleotide
  Target: ANGPTL3; (+) strand; PAM type: NRG; PAM sequence: AAG
tctttcaagctcatctactg

SEQ ID NO: 9862 - DNA, 20 bp, Artificial Sequence
  Description of Artificial Sequence: Synthetic oligonucleotide
  Target: ANGPTL3; (+) strand; PAM type: NRG; PAM sequence: AAG
ttcaagctcatctactgaag

SEQ ID NO: 9863 - DNA, 20 bp, Artificial Sequence
  Description of Artificial Sequence: Synthetic oligonucleotide
  Target: ANGPTL3; (+) strand; PAM type: NRG; PAM sequence: CAG
catctactgaagaagtgtaa

SEQ ID NO: 9864 - DNA, 20 bp, Artificial Sequence
  Description of Artificial Sequence: Synthetic oligonucleotide
  Target: ANGPTL3; (+) strand; PAM type: NRG; PAM sequence: CAG
ctactgaagaagtgtaacag

SEQ ID NO: 9865 - DNA, 20 bp, Artificial Sequence
  Description of Artificial Sequence: Synthetic oligonucleotide
  Target: ANGPTL3; (+) strand; PAM type: NRG; PAM sequence: GAG
actgaagaagtgtaacagca

SEQ ID NO: 9866 - DNA, 20 bp, Artificial Sequence
  Description of Artificial Sequence: Synthetic oligonucleotide
  Target: ANGPTL3; (+) strand; PAM type: NRG; PAM sequence: AGG
ctgaagaagtgtaacagcag

SEQ ID NO: 9867 - DNA, 20 bp, Artificial Sequence
  Description of Artificial Sequence: Synthetic oligonucleotide
  Target: ANGPTL3; (+) strand; PAM type: NRG; PAM sequence: TGG
aaacaaatccttttattgtc

SEQ ID NO: 9868 - DNA, 20 bp, Artificial Sequence
  Description of Artificial Sequence: Synthetic oligonucleotide
  Target: ANGPTL3; (+) strand; PAM type: NRG; PAM sequence: GAG
acaaatccttttattgtctg

SEQ ID NO: 9869 - DNA, 20 bp, Artificial Sequence
  Description of Artificial Sequence: Synthetic oligonucleotide
  Target: ANGPTL3; (+) strand; PAM type: NRG; PAM sequence: CAG
ccttttattgtctggagtta

SEQ ID NO: 9870 - DNA, 20 bp, Artificial Sequence
  Description of Artificial Sequence: Synthetic oligonucleotide
  Target: ANGPTL3; (+) strand; PAM type: NRG; PAM sequence: AGG
cttttattgtctggagttac

SEQ ID NO: 9871 - DNA, 20 bp, Artificial Sequence
  Description of Artificial Sequence: Synthetic oligonucleotide
  Target: ANGPTL3; (+) strand; PAM type: NRG; PAM sequence: CAG
ctatatgcacaaatttcttt

SEQ ID NO: 9872 - DNA, 20 bp, Artificial Sequence
  Description of Artificial Sequence: Synthetic oligonucleotide
  Target: ANGPTL3; (+) strand; PAM type: NRG; PAM sequence: TGG
aatttctttcagaatcttat

SEQ ID NO: 9873 - DNA, 20 bp, Artificial Sequence
  Description of Artificial Sequence: Synthetic oligonucleotide
  Target: ANGPTL3; (+) strand; PAM type: NRG; PAM sequence: GGG
atttctttcagaatcttatt

SEQ ID NO: 9874 - DNA, 20 bp, Artificial Sequence
  Description of Artificial Sequence: Synthetic oligonucleotide
  Target: ANGPTL3; (+) strand; PAM type: NRG; PAM sequence: TAG
tcagaatcttattgggatct

SEQ ID NO: 9875 - DNA, 20 bp, Artificial Sequence
  Description of Artificial Sequence: Synthetic oligonucleotide
  Target: ANGPTL3; (+) strand; PAM type: NRG; PAM sequence: TAG
tgggatcttagcttaaatct

SEQ ID NO: 9876 - DNA, 20 bp, Artificial Sequence
  Description of Artificial Sequence: Synthetic oligonucleotide
  Target: ANGPTL3; (+) strand; PAM type: NRG; PAM sequence: CAG
taaatctatcttcatgcctg

SEQ ID NO: 9877 - DNA, 20 bp, Artificial Sequence
  Description of Artificial Sequence: Synthetic oligonucleotide
  Target: ANGPTL3; (+) strand; PAM type: NRG; PAM sequence: TGG
atctatcttcatgcctgcag

SEQ ID NO: 9878 - DNA, 20 bp, Artificial Sequence
  Description of Artificial Sequence: Synthetic oligonucleotide
  Target: ANGPTL3; (+) strand; PAM type: NRG; PAM sequence: AAG
gtggctcacacctgtaatcc

SEQ ID NO: 9879 - DNA, 20 bp, Artificial Sequence
  Description of Artificial Sequence: Synthetic oligonucleotide
  Target: ANGPTL3; (+) strand; PAM type: NRG; PAM sequence: TGG
cacctgtaatccaagtattt

SEQ ID NO: 9880 - DNA, 20 bp, Artificial Sequence
  Description of Artificial Sequence: Synthetic oligonucleotide
  Target: ANGPTL3; (+) strand; PAM type: NRG; PAM sequence: GGG
acctgtaatccaagtatttt

SEQ ID NO: 9881 - DNA, 20 bp, Artificial Sequence
  Description of Artificial Sequence: Synthetic oligonucleotide
  Target: ANGPTL3; (+) strand; PAM type: NRG; PAM sequence: GAG
ctgtaatccaagtattttgg

SEQ ID NO: 9882 - DNA, 20 bp, Artificial Sequence
  Description of Artificial Sequence: Synthetic oligonucleotide
  Target: ANGPTL3; (+) strand; PAM type: NRG; PAM sequence: AGG
tgtaatccaagtattttggg

SEQ ID NO: 9883 - DNA, 20 bp, Artificial Sequence
  Description of Artificial Sequence: Synthetic oligonucleotide
  Target: ANGPTL3; (+) strand; PAM type: NRG; PAM sequence: CGG
atccaagtattttgggaggc

SEQ ID NO: 9884 - DNA, 20 bp, Artificial Sequence
  Description of Artificial Sequence: Synthetic oligonucleotide
  Target: ANGPTL3; (+) strand; PAM type: NRG; PAM sequence: GGG
tccaagtattttgggaggcc

SEQ ID NO: 9885 - DNA, 20 bp, Artificial Sequence
  Description of Artificial Sequence: Synthetic oligonucleotide
  Target: ANGPTL3; (+) strand; PAM type: NRG; PAM sequence: GGG
ccaagtattttgggaggccg

SEQ ID NO: 9886 - DNA, 20 bp, Artificial Sequence
  Description of Artificial Sequence: Synthetic oligonucleotide
  Target: ANGPTL3; (+) strand; PAM type: NRG; PAM sequence: CGG
agtattttgggaggccgggg

SEQ ID NO: 9887 - DNA, 20 bp, Artificial Sequence
  Description of Artificial Sequence: Synthetic oligonucleotide
  Target: ANGPTL3; (+) strand; PAM type: NRG; PAM sequence: GGG
gtattttgggaggccggggc

SEQ ID NO: 9888 - DNA, 20 bp, Artificial Sequence
  Description of Artificial Sequence: Synthetic oligonucleotide
  Target: ANGPTL3; (+) strand; PAM type: NRG; PAM sequence: GAG
attttgggaggccggggcgg

SEQ ID NO: 9889 - DNA, 20 bp, Artificial Sequence
  Description of Artificial Sequence: Synthetic oligonucleotide
  Target: ANGPTL3; (+) strand; PAM type: NRG; PAM sequence: CAG
gcgggagtactgcttgaacc

SEQ ID NO: 9890 - DNA, 20 bp, Artificial Sequence
  Description of Artificial Sequence: Synthetic oligonucleotide
  Target: ANGPTL3; (+) strand; PAM type: NRG; PAM sequence: AGG
cgggagtactgcttgaaccc

SEQ ID NO: 9891 - DNA, 20 bp, Artificial Sequence
  Description of Artificial Sequence: Synthetic oligonucleotide
  Target: ANGPTL3; (+) strand; PAM type: NRG; PAM sequence: GAG
ggagtactgcttgaacccag

SEQ ID NO: 9892 - DNA, 20 bp, Artificial Sequence
  Description of Artificial Sequence: Synthetic oligonucleotide
  Target: ANGPTL3; (+) strand; PAM type: NRG; PAM sequence: AAG
ctgcttgaacccaggagtcc

SEQ ID NO: 9893 - DNA, 20 bp, Artificial Sequence
  Description of Artificial Sequence: Synthetic oligonucleotide
  Target: ANGPTL3; (+) strand; PAM type: NRG; PAM sequence: CAG
tgaacccaggagtccaagat

SEQ ID NO: 9894 - DNA, 20 bp, Artificial Sequence
  Description of Artificial Sequence: Synthetic oligonucleotide
  Target: ANGPTL3; (+) strand; PAM type: NRG; PAM sequence: CGG
caagatcagcctgtgcaaca

SEQ ID NO: 9895 - DNA, 20 bp, Artificial Sequence
  Description of Artificial Sequence: Synthetic oligonucleotide
  Target: ANGPTL3; (+) strand; PAM type: NRG; PAM sequence: TAG
tctacaaaaaatacaaaaat

SEQ ID NO: 9896 - DNA, 20 bp, Artificial Sequence
  Description of Artificial Sequence: Synthetic oligonucleotide
  Target: ANGPTL3; (+) strand; PAM type: NRG; PAM sequence: TGG
caaaaaatacaaaaattagc

SEQ ID NO: 9897 - DNA, 20 bp, Artificial Sequence
  Description of Artificial Sequence: Synthetic oligonucleotide
  Target: ANGPTL3; (+) strand; PAM type: NRG; PAM sequence: GGG
aaaaaatacaaaaattagct

SEQ ID NO: 9898 - DNA, 20 bp, Artificial Sequence
  Description of Artificial Sequence: Synthetic oligonucleotide
  Target: ANGPTL3; (+) strand; PAM type: NRG; PAM sequence: TGG
atacaaaaattagctgggtg

SEQ ID NO: 9899 - DNA, 20 bp, Artificial Sequence
  Description of Artificial Sequence: Synthetic oligonucleotide
  Target: ANGPTL3; (+) strand; PAM type: NRG; PAM sequence: TGG
caaaaattagctgggtgtgg

SEQ ID NO: 9900 - DNA, 20 bp, Artificial Sequence
  Description of Artificial Sequence: Synthetic oligonucleotide
  Target: ANGPTL3; (+) strand; PAM type: NRG; PAM sequence: CAG
aaattagctgggtgtggtgg

SEQ ID NO: 9901 - DNA, 20 bp, Artificial Sequence
  Description of Artificial Sequence: Synthetic oligonucleotide
  Target: ANGPTL3; (+) strand; PAM type: NRG; PAM sequence: AGG
aattagctgggtgtggtggc

SEQ ID NO: 9902 - DNA, 20 bp, Artificial Sequence
  Description of Artificial Sequence: Synthetic oligonucleotide
  Target: ANGPTL3; (+) strand; PAM type: NRG; PAM sequence: TGG
tgcctgtaatcccaactact

SEQ ID NO: 9903 - DNA, 20 bp, Artificial Sequence
  Description of Artificial Sequence: Synthetic oligonucleotide
  Target: ANGPTL3; (+) strand; PAM type: NRG; PAM sequence: GGG
gcctgtaatcccaactactt

SEQ ID NO: 9904 - DNA, 20 bp, Artificial Sequence
  Description of Artificial Sequence: Synthetic oligonucleotide
  Target: ANGPTL3; (+) strand; PAM type: NRG; PAM sequence: GAG
ctgtaatcccaactacttgg

SEQ ID NO: 9905 - DNA, 20 bp, Artificial Sequence
  Description of Artificial Sequence: Synthetic oligonucleotide
  Target: ANGPTL3; (+) strand; PAM type: NRG; PAM sequence: AGG
tgtaatcccaactacttggg

SEQ ID NO: 9906 - DNA, 20 bp, Artificial Sequence
  Description of Artificial Sequence: Synthetic oligonucleotide
  Target: ANGPTL3; (+) strand; PAM type: NRG; PAM sequence: GAG
tcccaactacttgggaggct

SEQ ID NO: 9907 - DNA, 20 bp, Artificial Sequence
  Description of Artificial Sequence: Synthetic oligonucleotide
  Target: ANGPTL3; (+) strand; PAM type: NRG; PAM sequence: AGG
cccaactacttgggaggctg

SEQ ID NO: 9908 - DNA, 20 bp, Artificial Sequence
  Description of Artificial Sequence: Synthetic oligonucleotide
  Target: ANGPTL3; (+) strand; PAM type: NRG; PAM sequence: CAG
aactacttgggaggctgagg

SEQ ID NO: 9909 - DNA, 20 bp, Artificial Sequence
  Description of Artificial Sequence: Synthetic oligonucleotide
  Target: ANGPTL3; (+) strand; PAM type: NRG; PAM sequence: AGG
actacttgggaggctgaggc

SEQ ID NO: 9910 - DNA, 20 bp, Artificial Sequence
  Description of Artificial Sequence: Synthetic oligonucleotide
  Target: ANGPTL3; (+) strand; PAM type: NRG; PAM sequence: GAG
tacttgggaggctgaggcag

SEQ ID NO: 9911 - DNA, 20 bp, Artificial Sequence
  Description of Artificial Sequence: Synthetic oligonucleotide
  Target: ANGPTL3; (+) strand; PAM type: NRG; PAM sequence: TGG
ggctgaggcaggagaatcgc

SEQ ID NO: 9912 - DNA, 20 bp, Artificial Sequence
  Description of Artificial Sequence: Synthetic oligonucleotide
  Target: ANGPTL3; (+) strand; PAM type: NRG; PAM sequence: GAG
ctgaggcaggagaatcgctg

SEQ ID NO: 9913 - DNA, 20 bp, Artificial Sequence
  Description of Artificial Sequence: Synthetic oligonucleotide
  Target: ANGPTL3; (+) strand; PAM type: NRG; PAM sequence: TGG
gcaggagaatcgctggagcc

SEQ ID NO: 9914 - DNA, 20 bp, Artificial Sequence
  Description of Artificial Sequence: Synthetic oligonucleotide
  Target: ANGPTL3; (+) strand; PAM type: NRG; PAM sequence: GGG
caggagaatcgctggagcct

SEQ ID NO: 9915 - DNA, 20 bp, Artificial Sequence
  Description of Artificial Sequence: Synthetic oligonucleotide
  Target: ANGPTL3; (+) strand; PAM type: NRG; PAM sequence: AAG
gagaatcgctggagcctggg

SEQ ID NO: 9916 - DNA, 20 bp, Artificial Sequence
  Description of Artificial Sequence: Synthetic oligonucleotide
  Target: ANGPTL3; (+) strand; PAM type: NRG; PAM sequence: AAG
tcgctggagcctgggaagtc

SEQ ID NO: 9917 - DNA, 20 bp, Artificial Sequence
  Description of Artificial Sequence: Synthetic oligonucleotide
  Target: ANGPTL3; (+) strand; PAM type: NRG; PAM sequence: CAG
agcctgggaagtcaagcctg

SEQ ID NO: 9918 - DNA, 20 bp, Artificial Sequence
  Description of Artificial Sequence: Synthetic oligonucleotide
  Target: ANGPTL3; (+) strand; PAM type: NRG; PAM sequence: TAG
atgatcctaacactgcattc

SEQ ID NO: 9919 - DNA, 20 bp, Artificial Sequence
  Description of Artificial Sequence: Synthetic oligonucleotide
  Target: ANGPTL3; (+) strand; PAM type: NRG; PAM sequence: TGG
cctaacactgcattctagcc

SEQ ID NO: 9920 - DNA, 20 bp, Artificial Sequence
  Description of Artificial Sequence: Synthetic oligonucleotide
  Target: ANGPTL3; (+) strand; PAM type: NRG; PAM sequence: GGG
ctaacactgcattctagcct

SEQ ID NO: 9921 - DNA, 20 bp, Artificial Sequence
  Description of Artificial Sequence: Synthetic oligonucleotide
  Target: ANGPTL3; (+) strand; PAM type: NRG; PAM sequence: CAG
ctgcattctagcctgggcaa

SEQ ID NO: 9922 - DNA, 20 bp, Artificial Sequence
  Description of Artificial Sequence: Synthetic oligonucleotide
  Target: ANGPTL3; (+) strand; PAM type: NRG; PAM sequence: GAG
gcattctagcctgggcaaca

SEQ ID NO: 9923 - DNA, 20 bp, Artificial Sequence
  Description of Artificial Sequence: Synthetic oligonucleotide
  Target: ANGPTL3; (+) strand; PAM type: NRG; PAM sequence: GAG
tctagcctgggcaacagagt

SEQ ID NO: 9924 - DNA, 20 bp, Artificial Sequence
  Description of Artificial Sequence: Synthetic oligonucleotide
  Target: ANGPTL3; (+) strand; PAM type: NRG; PAM sequence: AAG
aaaaatatttatttcccccc

SEQ ID NO: 9925 - DNA, 20 bp, Artificial Sequence
  Description of Artificial Sequence: Synthetic oligonucleotide
  Target: ANGPTL3; (+) strand; PAM type: NRG; PAM sequence: AAG
tttccccccaagtatttaaa

SEQ ID NO: 9926 - DNA, 20 bp, Artificial Sequence
  Description of Artificial Sequence: Synthetic oligonucleotide
  Target: ANGPTL3; (+) strand; PAM type: NRG; PAM sequence: TAG
tatttaaaaagtgatgttcc

SEQ ID NO: 9927 - DNA, 20 bp, Artificial Sequence
  Description of Artificial Sequence: Synthetic oligonucleotide
  Target: ANGPTL3; (+) strand; PAM type: NRG; PAM sequence: AAG
ttaaaaagtgatgttcctag

SEQ ID NO: 9928 - DNA, 20 bp, Artificial Sequence
  Description of Artificial Sequence: Synthetic oligonucleotide
  Target: ANGPTL3; (+) strand; PAM type: NRG; PAM sequence: TAG
gtgaacttgcacgtcccata

SEQ ID NO: 9929 - DNA, 20 bp, Artificial Sequence
  Description of Artificial Sequence: Synthetic oligonucleotide
  Target: ANGPTL3; (+) strand; PAM type: NRG; PAM sequence: AAG
ccatatagttgtgccctcac

SEQ ID NO: 9930 - DNA, 20 bp, Artificial Sequence
  Description of Artificial Sequence: Synthetic oligonucleotide
  Target: ANGPTL3; (+) strand; PAM type: NRG; PAM sequence: TAG
acaagaatgtatactccaat

SEQ ID NO: 9931 - DNA, 20 bp, Artificial Sequence
  Description of Artificial Sequence: Synthetic oligonucleotide
  Target: ANGPTL3; (+) strand; PAM type: NRG; PAM sequence: AAG
agaatgtatactccaattag

SEQ ID NO: 9932 - DNA, 20 bp, Artificial Sequence
  Description of Artificial Sequence: Synthetic oligonucleotide
  Target: ANGPTL3; (+) strand; PAM type: NRG; PAM sequence: GAG
aatgtatactccaattagaa

SEQ ID NO: 9933 - DNA, 20 bp, Artificial Sequence
  Description of Artificial Sequence: Synthetic oligonucleotide
  Target: ANGPTL3; (+) strand; PAM type: NRG; PAM sequence: TAG
atactccaattagaagagta

SEQ ID NO: 9934 - DNA, 20 bp, Artificial Sequence
  Description of Artificial Sequence: Synthetic oligonucleotide
  Target: ANGPTL3; (+) strand; PAM type: NRG; PAM sequence: AGG
tactccaattagaagagtat

SEQ ID NO: 9935 - DNA, 20 bp, Artificial Sequence
  Description of Artificial Sequence: Synthetic oligonucleotide
  Target: ANGPTL3; (+) strand; PAM type: NRG; PAM sequence: TGG
attagaagagtataggcctt

SEQ ID NO: 9936 - DNA, 20 bp, Artificial Sequence
  Description of Artificial Sequence: Synthetic oligonucleotide
  Target: ANGPTL3; (+) strand; PAM type: NRG; PAM sequence: CAG
aacaaaatccaaaatccttc

SEQ ID NO: 9937 - DNA, 20 bp, Artificial Sequence
  Description of Artificial Sequence: Synthetic oligonucleotide
  Target: ANGPTL3; (+) strand; PAM type: NRG; PAM sequence: AGG
acaaaatccaaaatccttcc

SEQ ID NO: 9938 - DNA, 20 bp, Artificial Sequence
  Description of Artificial Sequence: Synthetic oligonucleotide
  Target: ANGPTL3; (+) strand; PAM type: NRG; PAM sequence: AAG
aaatccttccaggttttcaa

SEQ ID NO: 9939 - DNA, 20 bp, Artificial Sequence
  Description of Artificial Sequence: Synthetic oligonucleotide
  Target: ANGPTL3; (+) strand; PAM type: NRG; PAM sequence: TGG
tttcaaaagtctctatcacc

SEQ ID NO: 9940 - DNA, 20 bp, Artificial Sequence
  Description of Artificial Sequence: Synthetic oligonucleotide
  Target: ANGPTL3; (+) strand; PAM type: NRG; PAM sequence: CAG
ctggccccaaattacctctt

SEQ ID NO: 9941 - DNA, 20 bp, Artificial Sequence
  Description of Artificial Sequence: Synthetic oligonucleotide
  Target: ANGPTL3; (+) strand; PAM type: NRG; PAM sequence: TAG
cctaatgtattccatttgtc

SEQ ID NO: 9942 - DNA, 20 bp, Artificial Sequence
  Description of Artificial Sequence: Synthetic oligonucleotide
  Target: ANGPTL3; (+) strand; PAM type: NRG; PAM sequence: TGG
tctccccacacatttctgat

SEQ ID NO: 9943 - DNA, 20 bp, Artificial Sequence
  Description of Artificial Sequence: Synthetic oligonucleotide
  Target: ANGPTL3; (+) strand; PAM type: NRG; PAM sequence: TAG
cccacacatttctgattggc

SEQ ID NO: 9944 - DNA, 20 bp, Artificial Sequence
  Description of Artificial Sequence: Synthetic oligonucleotide
  Target: ANGPTL3; (+) strand; PAM type: NRG; PAM sequence: AAG
gctagattgtgccgtatttt

SEQ ID NO: 9945 - DNA, 20 bp, Artificial Sequence
  Description of Artificial Sequence: Synthetic oligonucleotide
  Target: ANGPTL3; (+) strand; PAM type: NRG; PAM sequence: AGG
ctagattgtgccgtatttta

SEQ ID NO: 9946 - DNA, 20 bp, Artificial Sequence
  Description of Artificial Sequence: Synthetic oligonucleotide
  Target: ANGPTL3; (+) strand; PAM type: NRG; PAM sequence: CAG
ttgtgccgtattttaaggtg

SEQ ID NO: 9947 - DNA, 20 bp, Artificial Sequence
  Description of Artificial Sequence: Synthetic oligonucleotide
  Target: ANGPTL3; (+) strand; PAM type: NRG; PAM sequence: TAG
caattcttccacaaatattc

SEQ ID NO: 9948 - DNA, 20 bp, Artificial Sequence
  Description of Artificial Sequence: Synthetic oligonucleotide
  Target: ANGPTL3; (+) strand; PAM type: NRG; PAM sequence: TGG
tccacaaatattctagtaaa

SEQ ID NO: 9949 - DNA, 20 bp, Artificial Sequence
  Description of Artificial Sequence: Synthetic oligonucleotide
  Target: ANGPTL3; (+) strand; PAM type: NRG; PAM sequence: CAG
acaaatattctagtaaatgg

SEQ ID NO: 9950 - DNA, 20 bp, Artificial Sequence
  Description of Artificial Sequence: Synthetic oligonucleotide
  Target: ANGPTL3; (+) strand; PAM type: NRG; PAM sequence: CAG
cttgttcatctgaaaccaca

SEQ ID NO: 9951 - DNA, 20 bp, Artificial Sequence
  Description of Artificial Sequence: Synthetic oligonucleotide
  Target: ANGPTL3; (+) strand; PAM type: NRG; PAM sequence: TGG
tactgtccatacacctcaaa

SEQ ID NO: 9952 - DNA, 20 bp, Artificial Sequence
  Description of Artificial Sequence: Synthetic oligonucleotide
  Target: ANGPTL3; (+) strand; PAM type: NRG; PAM sequence: TAG
catacacctcaaatggcact

SEQ ID NO: 9953 - DNA, 20 bp, Artificial Sequence
  Description of Artificial Sequence: Synthetic oligonucleotide
  Target: ANGPTL3; (+) strand; PAM type: NRG; PAM sequence: GAG
cacctcaaatggcacttagt

SEQ ID NO: 9954 - DNA, 20 bp, Artificial Sequence
  Description of Artificial Sequence: Synthetic oligonucleotide
  Target: ANGPTL3; (+) strand; PAM type: NRG; PAM sequence: CAG
gcacttagtgagaaaataca

SEQ ID NO: 9955 - DNA, 20 bp, Artificial Sequence
  Description of Artificial Sequence: Synthetic oligonucleotide
  Target: ANGPTL3; (+) strand; PAM type: NRG; PAM sequence: TGG
gtgagaaaatacacagaata

SEQ ID NO: 9956 - DNA, 20 bp, Artificial Sequence
  Description of Artificial Sequence: Synthetic oligonucleotide
  Target: ANGPTL3; (+) strand; PAM type: NRG; PAM sequence: TAG
ataataaaaattctgaaaaa

SEQ ID NO: 9957 - DNA, 20 bp, Artificial Sequence
  Description of Artificial Sequence: Synthetic oligonucleotide
  Target: ANGPTL3; (+) strand; PAM type: NRG; PAM sequence: AAG
attctgaaaaatagtactaa

SEQ ID NO: 9958 - DNA, 20 bp, Artificial Sequence
  Description of Artificial Sequence: Synthetic oligonucleotide
  Target: ANGPTL3; (+) strand; PAM type: NRG; PAM sequence: AAG
aatagtactaaaagctccaa

SEQ ID NO: 9959 - DNA, 20 bp, Artificial Sequence
  Description of Artificial Sequence: Synthetic oligonucleotide
  Target: ANGPTL3; (+) strand; PAM type: NRG; PAM sequence: AAG
taaaagctccaaaagcatca

SEQ ID NO: 9960 - DNA, 20 bp, Artificial Sequence
  Description of Artificial Sequence: Synthetic oligonucleotide
  Target: ANGPTL3; (+) strand; PAM type: NRG; PAM sequence: TAG
agctccaaaagcatcaaaga

SEQ ID NO: 9961 - DNA, 20 bp, Artificial Sequence
  Description of Artificial Sequence: Synthetic oligonucleotide
  Target: ANGPTL3; (+) strand; PAM type: NRG; PAM sequence: CAG
ccaaaagcatcaaagatagt

SEQ ID NO: 9962 - DNA, 20 bp, Artificial Sequence
  Description of Artificial Sequence: Synthetic oligonucleotide
  Target: ANGPTL3; (+) strand; PAM type: NRG; PAM sequence: TAG
atagtcagtttacctgattt

SEQ ID NO: 9963 - DNA, 20 bp, Artificial Sequence
  Description of Artificial Sequence: Synthetic oligonucleotide
  Target: ANGPTL3; (+) strand; PAM type: NRG; PAM sequence: AAG
tactgaaaaatttctatatc

SEQ ID NO: 9964 - DNA, 20 bp, Artificial Sequence
  Description of Artificial Sequence: Synthetic oligonucleotide
  Target: ANGPTL3; (+) strand; PAM type: NRG; PAM sequence: GAG
ctgaaaaatttctatatcaa

SEQ ID NO: 9965 - DNA, 20 bp, Artificial Sequence
  Description of Artificial Sequence: Synthetic oligonucleotide
  Target: ANGPTL3; (+) strand; PAM type: NRG; PAM sequence: CAG
atcaagagtttattttgaac

SEQ ID NO: 9966 - DNA, 20 bp, Artificial Sequence
  Description of Artificial Sequence: Synthetic oligonucleotide
  Target: ANGPTL3; (+) strand; PAM type: NRG; PAM sequence: AAG
gtatgaattttactgaaacc

SEQ ID NO: 9967 - DNA, 20 bp, Artificial Sequence
  Description of Artificial Sequence: Synthetic oligonucleotide
  Target: ANGPTL3; (+) strand; PAM type: NRG; PAM sequence: GAG
gtacacacatgtctcattat

SEQ ID NO: 9968 - DNA, 20 bp, Artificial Sequence
  Description of Artificial Sequence: Synthetic oligonucleotide
  Target: ANGPTL3; (+) strand; PAM type: NRG; PAM sequence: AGG
tacacacatgtctcattatg

SEQ ID NO: 9969 - DNA, 20 bp, Artificial Sequence
  Description of Artificial Sequence: Synthetic oligonucleotide
  Target: ANGPTL3; (+) strand; PAM type: NRG; PAM sequence: TAG
tgtctcattatgaggtaatc

SEQ ID NO: 9970 - DNA, 20 bp, Artificial Sequence
  Description of Artificial Sequence: Synthetic oligonucleotide
  Target: ANGPTL3; (+) strand; PAM type: NRG; PAM sequence: TAG
cattatgaggtaatctagtg

SEQ ID NO: 9971 - DNA, 20 bp, Artificial Sequence
  Description of Artificial Sequence: Synthetic oligonucleotide
  Target: ANGPTL3; (+) strand; PAM type: NRG; PAM sequence: TGG
ttccatacactctgtcatcc

SEQ ID NO: 9972 - DNA, 20 bp, Artificial Sequence
  Description of Artificial Sequence: Synthetic oligonucleotide
  Target: ANGPTL3; (+) strand; PAM type: NRG; PAM sequence: CAG
acactctgtcatcctggaat

SEQ ID NO: 9973 - DNA, 20 bp, Artificial Sequence
  Description of Artificial Sequence: Synthetic oligonucleotide
  Target: ANGPTL3; (+) strand; PAM type: NRG; PAM sequence: TAG
cttgtatctttacttcctaa

SEQ ID NO: 9974 - DNA, 20 bp, Artificial Sequence
  Description of Artificial Sequence: Synthetic oligonucleotide
  Target: ANGPTL3; (+) strand; PAM type: NRG; PAM sequence: TGG
cttcctaatagcataactca

SEQ ID NO: 9975 - DNA, 20 bp, Artificial Sequence
  Description of Artificial Sequence: Synthetic oligonucleotide
  Target: ANGPTL3; (+) strand; PAM type: NRG; PAM sequence: AAG
cctaatagcataactcatgg

SEQ ID NO: 9976 - DNA, 20 bp, Artificial Sequence
  Description of Artificial Sequence: Synthetic oligonucleotide
  Target: ANGPTL3; (+) strand; PAM type: NRG; PAM sequence: TAG
actaactcattcattaattt

SEQ ID NO: 9977 - DNA, 20 bp, Artificial Sequence
  Description of Artificial Sequence: Synthetic oligonucleotide
  Target: ANGPTL3; (+) strand; PAM type: NRG; PAM sequence: TGG
tcattcattaattttagaaa

SEQ ID NO: 9978 - DNA, 20 bp, Artificial Sequence
  Description of Artificial Sequence: Synthetic oligonucleotide
  Target: ANGPTL3; (+) strand; PAM type: NRG; PAM sequence: GAG
ttcattaaacaacacttatt

SEQ ID NO: 9979 - DNA, 20 bp, Artificial Sequence
  Description of Artificial Sequence: Synthetic oligonucleotide
  Target: ANGPTL3; (+) strand; PAM type: NRG; PAM sequence: TAG
atatactctaccttctgctg

SEQ ID NO: 9980 - DNA, 20 bp, Artificial Sequence
  Description of Artificial Sequence: Synthetic oligonucleotide
  Target: ANGPTL3; (+) strand; PAM type: NRG; PAM sequence: AGG
tatactctaccttctgctgt

SEQ ID NO: 9981 - DNA, 20 bp, Artificial Sequence
  Description of Artificial Sequence: Synthetic oligonucleotide
  Target: ANGPTL3; (+) strand; PAM type: NRG; PAM sequence: CAG
atttttttccccatcactaa

SEQ ID NO: 9982 - DNA, 20 bp, Artificial Sequence
  Description of Artificial Sequence: Synthetic oligonucleotide
  Target: ANGPTL3; (+) strand; PAM type: NRG; PAM sequence: GAG
gcacttatgtatgtactact

SEQ ID NO: 9983 - DNA, 20 bp, Artificial Sequence
  Description of Artificial Sequence: Synthetic oligonucleotide
  Target: ANGPTL3; (+) strand; PAM type: NRG; PAM sequence: CAG
tactgagtgattatcaaaca

SEQ ID NO: 9984 - DNA, 20 bp, Artificial Sequence
  Description of Artificial Sequence: Synthetic oligonucleotide
  Target: ANGPTL3; (+) strand; PAM type: NRG; PAM sequence: CAG
tgagtgattatcaaacacag

SEQ ID NO: 9985 - DNA, 20 bp, Artificial Sequence
  Description of Artificial Sequence: Synthetic oligonucleotide
  Target: ANGPTL3; (+) strand; PAM type: NRG; PAM sequence: AAG
acagcagttttaaaaatgaa

SEQ ID NO: 9986 - DNA, 20 bp, Artificial Sequence
  Description of Artificial Sequence: Synthetic oligonucleotide
  Target: ANGPTL3; (+) strand; PAM type: NRG; PAM sequence: AAG
cagttttaaaaatgaaaaga

SEQ ID NO: 9987 - DNA, 20 bp, Artificial Sequence
  Description of Artificial Sequence: Synthetic oligonucleotide
  Target: ANGPTL3; (+) strand; PAM type: NRG; PAM sequence: TGG
aaagaaagtgacccaacaat

SEQ ID NO: 9988 - DNA, 20 bp, Artificial Sequence
  Description of Artificial Sequence: Synthetic oligonucleotide
  Target: ANGPTL3; (+) strand; PAM type: NRG; PAM sequence: AAG
aacaattggcccttttatca

SEQ ID NO: 9989 - DNA, 20 bp, Artificial Sequence
  Description of Artificial Sequence: Synthetic oligonucleotide
  Target: ANGPTL3; (+) strand; PAM type: NRG; PAM sequence: AAG
ggcccttttatcaaagtcca

SEQ ID NO: 9990 - DNA, 20 bp, Artificial Sequence
  Description of Artificial Sequence: Synthetic oligonucleotide
  Target: ANGPTL3; (+) strand; PAM type: NRG; PAM sequence: TGG
caaagtccaaagtattatca

SEQ ID NO: 9991 - DNA, 20 bp, Artificial Sequence
  Description of Artificial Sequence: Synthetic oligonucleotide
  Target: ANGPTL3; (+) strand; PAM type: NRG; PAM sequence: TAG
tattatcatggcaaatcaac

SEQ ID NO: 9992 - DNA, 20 bp, Artificial Sequence
  Description of Artificial Sequence: Synthetic oligonucleotide
  Target: ANGPTL3; (+) strand; PAM type: NRG; PAM sequence: AGG
attatcatggcaaatcaact

SEQ ID NO: 9993 - DNA, 20 bp, Artificial Sequence
  Description of Artificial Sequence: Synthetic oligonucleotide
  Target: ANGPTL3; (+) strand; PAM type: NRG; PAM sequence: GGG
ttatcatggcaaatcaacta

SEQ ID NO: 9994 - DNA, 20 bp, Artificial Sequence
  Description of Artificial Sequence: Synthetic oligonucleotide
  Target: ANGPTL3; (+) strand; PAM type: NRG; PAM sequence: TGG
ctagggtaaaattacttaac

SEQ ID NO: 9995 - DNA, 20 bp, Artificial Sequence
  Description of Artificial Sequence: Synthetic oligonucleotide
  Target: ANGPTL3; (+) strand; PAM type: NRG; PAM sequence: CAG
aaaattacttaactggtgca

SEQ ID NO: 9996 - DNA, 20 bp, Artificial Sequence
  Description of Artificial Sequence: Synthetic oligonucleotide
  Target: ANGPTL3; (+) strand; PAM type: NRG; PAM sequence: AAG
acttaactggtgcacagttc

SEQ ID NO: 9997 - DNA, 20 bp, Artificial Sequence
  Description of Artificial Sequence: Synthetic oligonucleotide
  Target: ANGPTL3; (+) strand; PAM type: NRG; PAM sequence: AGG
cttaactggtgcacagttca

SEQ ID NO: 9998 - DNA, 20 bp, Artificial Sequence
  Description of Artificial Sequence: Synthetic oligonucleotide
  Target: ANGPTL3; (+) strand; PAM type: NRG; PAM sequence: AAG
tgcacagttcaaggtcatga

SEQ ID NO: 9999 - DNA, 20 bp, Artificial Sequence
  Description of Artificial Sequence: Synthetic oligonucleotide
  Target: ANGPTL3; (+) strand; PAM type: NRG; PAM sequence: TAG
acagttcaaggtcatgaaag

SEQ ID NO: 10000 - DNA, 20 bp, Artificial Sequence
  Description of Artificial Sequence: Synthetic oligonucleotide
  Target: ANGPTL3; (+) strand; PAM type: NRG; PAM sequence: GAG
attataacccttaataaaat

SEQ ID NO: 10001 - DNA, 20 bp, Artificial Sequence
  Description of Artificial Sequence: Synthetic oligonucleotide
  Target: ANGPTL3; (+) strand; PAM type: NRG; PAM sequence: AGG
ttataacccttaataaaatg

SEQ ID NO: 10002 - DNA, 20 bp, Artificial Sequence
  Description of Artificial Sequence: Synthetic oligonucleotide
  Target: ANGPTL3; (+) strand; PAM type: NRG; PAM sequence: TAG
atgaggttttaatgacattt

SEQ ID NO: 10003 - DNA, 20 bp, Artificial Sequence
  Description of Artificial Sequence: Synthetic oligonucleotide
  Target: ANGPTL3; (+) strand; PAM type: NRG; PAM sequence: AGG
tgaggttttaatgacatttt

SEQ ID NO: 10004 - DNA, 20 bp, Artificial Sequence
  Description of Artificial Sequence: Synthetic oligonucleotide
  Target: ANGPTL3; (+) strand; PAM type: NRG; PAM sequence: AAG
aggaaatataaaataaactt

SEQ ID NO: 10005 - DNA, 20 bp, Artificial Sequence
  Description of Artificial Sequence: Synthetic oligonucleotide
  Target: ANGPTL3; (+) strand; PAM type: NRG; PAM sequence: AAG
agaattctatctaaaataca

SEQ ID NO: 10006 - DNA, 20 bp, Artificial Sequence
  Description of Artificial Sequence: Synthetic oligonucleotide
  Target: ANGPTL3; (+) strand; PAM type: NRG; PAM sequence: AGG
gaattctatctaaaatacaa

SEQ ID NO: 10007 - DNA, 20 bp, Artificial Sequence
  Description of Artificial Sequence: Synthetic oligonucleotide
  Target: ANGPTL3; (+) strand; PAM type: NRG; PAM sequence: TAG
gtttttcctaaattcatgtt

SEQ ID NO: 10008 - DNA, 20 bp, Artificial Sequence
  Description of Artificial Sequence: Synthetic oligonucleotide
  Target: ANGPTL3; (+) strand; PAM type: NRG; PAM sequence: AAG
ctaaattcatgtttagtcct

SEQ ID NO: 10009 - DNA, 20 bp, Artificial Sequence
  Description of Artificial Sequence: Synthetic oligonucleotide
  Target: ANGPTL3; (+) strand; PAM type: NRG; PAM sequence: CAG
ttcatgtttagtcctaagaa

SEQ ID NO: 10010 - DNA, 20 bp, Artificial Sequence
  Description of Artificial Sequence: Synthetic oligonucleotide
  Target: ANGPTL3; (+) strand; PAM type: NRG; PAM sequence: TGG
catacatctaataaaatgac

SEQ ID NO: 10011 - DNA, 20 bp, Artificial Sequence
  Description of Artificial Sequence: Synthetic oligonucleotide
  Target: ANGPTL3; (+) strand; PAM type: NRG; PAM sequence: GGG
atacatctaataaaatgact

SEQ ID NO: 10012 - DNA, 20 bp, Artificial Sequence
  Description of Artificial Sequence: Synthetic oligonucleotide
  Target: ANGPTL3; (+) strand; PAM type: NRG; PAM sequence: AAG
tgactgggtatataatttga

SEQ ID NO: 10013 - DNA, 20 bp, Artificial Sequence
  Description of Artificial Sequence: Synthetic oligonucleotide
  Target: ANGPTL3; (+) strand; PAM type: NRG; PAM sequence: GAG
actgggtatataatttgaaa

SEQ ID NO: 10014 - DNA, 20 bp, Artificial Sequence
  Description of Artificial Sequence: Synthetic oligonucleotide
  Target: ANGPTL3; (+) strand; PAM type: NRG; PAM sequence: AAG
agcaataaattactaccttg

SEQ ID NO: 10015 - DNA, 20 bp, Artificial Sequence
  Description of Artificial Sequence: Synthetic oligonucleotide
  Target: ANGPTL3; (+) strand; PAM type: NRG; PAM sequence: AAG
aattactaccttgaagatgt

SEQ ID NO: 10016 - DNA, 20 bp, Artificial Sequence
  Description of Artificial Sequence: Synthetic oligonucleotide
  Target: ANGPTL3; (+) strand; PAM type: NRG; PAM sequence: AGG
attactaccttgaagatgta

SEQ ID NO: 10017 - DNA, 20 bp, Artificial Sequence
  Description of Artificial Sequence: Synthetic oligonucleotide
  Target: ANGPTL3; (+) strand; PAM type: NRG; PAM sequence: TAG
accttgaagatgtaaggttg

SEQ ID NO: 10018 - DNA, 20 bp, Artificial Sequence
  Description of Artificial Sequence: Synthetic oligonucleotide
  Target: ANGPTL3; (+) strand; PAM type: NRG; PAM sequence: CAG
gctatttatcttaaaataca

SEQ ID NO: 10019 - DNA, 20 bp, Artificial Sequence
  Description of Artificial Sequence: Synthetic oligonucleotide
  Target: ANGPTL3; (+) strand; PAM type: NRG; PAM sequence: CAG
taaaatacacagtcaaacct

SEQ ID NO: 10020 - DNA, 20 bp, Artificial Sequence
  Description of Artificial Sequence: Synthetic oligonucleotide
  Target: ANGPTL3; (+) strand; PAM type: NRG; PAM sequence: TAG
acctcagtttccacacccaa

SEQ ID NO: 10021 - DNA, 20 bp, Artificial Sequence
  Description of Artificial Sequence: Synthetic oligonucleotide
  Target: ANGPTL3; (+) strand; PAM type: NRG; PAM sequence: TGG
cagtttccacacccaataga

SEQ ID NO: 10022 - DNA, 20 bp, Artificial Sequence
  Description of Artificial Sequence: Synthetic oligonucleotide
  Target: ANGPTL3; (+) strand; PAM type: NRG; PAM sequence: GGG
agtttccacacccaatagat

SEQ ID NO: 10023 - DNA, 20 bp, Artificial Sequence
  Description of Artificial Sequence: Synthetic oligonucleotide
  Target: ANGPTL3; (+) strand; PAM type: NRG; PAM sequence: TGG
tcaaatctattaatacttca

SEQ ID NO: 10024 - DNA, 20 bp, Artificial Sequence
  Description of Artificial Sequence: Synthetic oligonucleotide
  Target: ANGPTL3; (+) strand; PAM type: NRG; PAM sequence: GGG
caaatctattaatacttcat

SEQ ID NO: 10025 - DNA, 20 bp, Artificial Sequence
  Description of Artificial Sequence: Synthetic oligonucleotide
  Target: ANGPTL3; (+) strand; PAM type: NRG; PAM sequence: AAG
ttcatgggattgtaatcatc

SEQ ID NO: 10026 - DNA, 20 bp, Artificial Sequence
  Description of Artificial Sequence: Synthetic oligonucleotide
  Target: ANGPTL3; (+) strand; PAM type: NRG; PAM sequence: CAG
tgggattgtaatcatcaagc

SEQ ID NO: 10027 - DNA, 20 bp, Artificial Sequence
  Description of Artificial Sequence: Synthetic oligonucleotide
  Target: ANGPTL3; (+) strand; PAM type: NRG; PAM sequence: TAG
agccagataatgtatttgaa

SEQ ID NO: 10028 - DNA, 20 bp, Artificial Sequence
  Description of Artificial Sequence: Synthetic oligonucleotide
  Target: ANGPTL3; (+) strand; PAM type: NRG; PAM sequence: AAG
gaatagctttatgaactata

SEQ ID NO: 10029 - DNA, 20 bp, Artificial Sequence
  Description of Artificial Sequence: Synthetic oligonucleotide
  Target: ANGPTL3; (+) strand; PAM type: NRG; PAM sequence: CAG
atgtatatactttttaaaaa

SEQ ID NO: 10030 - DNA, 20 bp, Artificial Sequence
  Description of Artificial Sequence: Synthetic oligonucleotide
  Target: ANGPTL3; (+) strand; PAM type: NRG; PAM sequence: AGG
tgtatatactttttaaaaac

SEQ ID NO: 10031 - DNA, 20 bp, Artificial Sequence
  Description of Artificial Sequence: Synthetic oligonucleotide
  Target: ANGPTL3; (+) strand; PAM type: NRG; PAM sequence: AAG
gtcatttttcacattccttt

SEQ ID NO: 10032 - DNA, 20 bp, Artificial Sequence
  Description of Artificial Sequence: Synthetic oligonucleotide
  Target: ANGPTL3; (+) strand; PAM type: NRG; PAM sequence: CAG
actgaacatattataattct

SEQ ID NO: 10033 - DNA, 20 bp, Artificial Sequence
  Description of Artificial Sequence: Synthetic oligonucleotide
  Target: ANGPTL3; (+) strand; PAM type: NRG; PAM sequence: AGG
ctgaacatattataattctc

SEQ ID NO: 10034 - DNA, 20 bp, Artificial Sequence
  Description of Artificial Sequence: Synthetic oligonucleotide
  Target: ANGPTL3; (+) strand; PAM type: NRG; PAM sequence: CAG
acatattataattctcagga

SEQ ID NO: 10035 - DNA, 20 bp, Artificial Sequence
  Description of Artificial Sequence: Synthetic oligonucleotide
  Target: ANGPTL3; (+) strand; PAM type: NRG; PAM sequence: AAG
tattataattctcaggacag

SEQ ID NO: 10036 - DNA, 20 bp, Artificial Sequence
  Description of Artificial Sequence: Synthetic oligonucleotide
  Target: ANGPTL3; (+) strand; PAM type: NRG; PAM sequence: CAG
aagaacaaaactgcccttct

SEQ ID NO: 10037 - DNA, 20 bp, Artificial Sequence
  Description of Artificial Sequence: Synthetic oligonucleotide
  Target: ANGPTL3; (+) strand; PAM type: NRG; PAM sequence: GAG
gaacaaaactgcccttctca

SEQ ID NO: 10038 - DNA, 20 bp, Artificial Sequence
  Description of Artificial Sequence: Synthetic oligonucleotide
  Target: ANGPTL3; (+) strand; PAM type: NRG; PAM sequence: TGG
tcagagtttgcatctgtttc

SEQ ID NO: 10039 - DNA, 20 bp, Artificial Sequence
  Description of Artificial Sequence: Synthetic oligonucleotide
  Target: ANGPTL3; (+) strand; PAM type: NRG; PAM sequence: AAG
actccttcccttcacaatct

SEQ ID NO: 10040 - DNA, 20 bp, Artificial Sequence
  Description of Artificial Sequence: Synthetic oligonucleotide
  Target: ANGPTL3; (+) strand; PAM type: NRG; PAM sequence: CAG
agataacactccatcacctt

SEQ ID NO: 10041 - DNA, 20 bp, Artificial Sequence
  Description of Artificial Sequence: Synthetic oligonucleotide
  Target: ANGPTL3; (+) strand; PAM type: NRG; PAM sequence: AAG
actccatcaccttcagatgc

SEQ ID NO: 10042 - DNA, 20 bp, Artificial Sequence
  Description of Artificial Sequence: Synthetic oligonucleotide
  Target: ANGPTL3; (+) strand; PAM type: NRG; PAM sequence: TGG
agcccctaactaaaaacttc

SEQ ID NO: 10043 - DNA, 20 bp, Artificial Sequence
  Description of Artificial Sequence: Synthetic oligonucleotide
  Target: ANGPTL3; (+) strand; PAM type: NRG; PAM sequence: GGG
gcccctaactaaaaacttct

SEQ ID NO: 10044 - DNA, 20 bp, Artificial Sequence
  Description of Artificial Sequence: Synthetic oligonucleotide
  Target: ANGPTL3; (+) strand; PAM type: NRG; PAM sequence: TGG
cctaactaaaaacttctggg

SEQ ID NO: 10045 - DNA, 20 bp, Artificial Sequence
  Description of Artificial Sequence: Synthetic oligonucleotide
  Target: ANGPTL3; (+) strand; PAM type: NRG; PAM sequence: TAG
gggtggctatgttaaaatgt

SEQ ID NO: 10046 - DNA, 20 bp, Artificial Sequence
  Description of Artificial Sequence: Synthetic oligonucleotide
  Target: ANGPTL3; (+) strand; PAM type: NRG; PAM sequence: AGG
ggtggctatgttaaaatgtt

SEQ ID NO: 10047 - DNA, 20 bp, Artificial Sequence
  Description of Artificial Sequence: Synthetic oligonucleotide
  Target: ANGPTL3; (+) strand; PAM type: NRG; PAM sequence: TAG
tatgttaaaatgttaggaaa

SEQ ID NO: 10048 - DNA, 20 bp, Artificial Sequence
  Description of Artificial Sequence: Synthetic oligonucleotide
  Target: ANGPTL3; (+) strand; PAM type: NRG; PAM sequence: GAG
tgttaaaatgttaggaaata

SEQ ID NO: 10049 - DNA, 20 bp, Artificial Sequence
  Description of Artificial Sequence: Synthetic oligonucleotide
  Target: ANGPTL3; (+) strand; PAM type: NRG; PAM sequence: CAG
aggaaatagagctcttgact

SEQ ID NO: 10050 - DNA, 20 bp, Artificial Sequence
  Description of Artificial Sequence: Synthetic oligonucleotide
  Target: ANGPTL3; (+) strand; PAM type: NRG; PAM sequence: GAG
tcagaattcttttttttttc

SEQ ID NO: 10051 - DNA, 20 bp, Artificial Sequence
  Description of Artificial Sequence: Synthetic oligonucleotide
  Target: ANGPTL3; (+) strand; PAM type: NRG; PAM sequence: TGG
aattcttttttttttcgaga

SEQ ID NO: 10052 - DNA, 20 bp, Artificial Sequence
  Description of Artificial Sequence: Synthetic oligonucleotide
  Target: ANGPTL3; (+) strand; PAM type: NRG; PAM sequence: GAG
ttcttttttttttcgagatg

SEQ ID NO: 10053 - DNA, 20 bp, Artificial Sequence
  Description of Artificial Sequence: Synthetic oligonucleotide
  Target: ANGPTL3; (+) strand; PAM type: NRG; PAM sequence: CAG
tggagtctcgctctgtcacc

SEQ ID NO: 10054 - DNA, 20 bp, Artificial Sequence
  Description of Artificial Sequence: Synthetic oligonucleotide
  Target: ANGPTL3; (+) strand; PAM type: NRG; PAM sequence: AGG
ggagtctcgctctgtcaccc

SEQ ID NO: 10055 - DNA, 20 bp, Artificial Sequence
  Description of Artificial Sequence: Synthetic oligonucleotide
  Target: ANGPTL3; (+) strand; PAM type: NRG; PAM sequence: TGG
tctcgctctgtcacccaggc

SEQ ID NO: 10056 - DNA, 20 bp, Artificial Sequence
  Description of Artificial Sequence: Synthetic oligonucleotide
  Target: ANGPTL3; (+) strand; PAM type: NRG; PAM sequence: GAG
tcgctctgtcacccaggctg

SEQ ID NO: 10057 - DNA, 20 bp, Artificial Sequence
  Description of Artificial Sequence: Synthetic oligonucleotide
  Target: ANGPTL3; (+) strand; PAM type: NRG; PAM sequence: CAG
ctgtcacccaggctggagtg

SEQ ID NO: 10058 - DNA, 20 bp, Artificial Sequence
  Description of Artificial Sequence: Synthetic oligonucleotide
  Target: ANGPTL3; (+) strand; PAM type: NRG; PAM sequence: TGG
tcacccaggctggagtgcag

SEQ ID NO: 10059 - DNA, 20 bp, Artificial Sequence
  Description of Artificial Sequence: Synthetic oligonucleotide
  Target: ANGPTL3; (+) strand; PAM type: NRG; PAM sequence: CAG
tggagtgcagtggcactgca

SEQ ID NO: 10060 - DNA, 20 bp, Artificial Sequence
  Description of Artificial Sequence: Synthetic oligonucleotide
  Target: ANGPTL3; (+) strand; PAM type: NRG; PAM sequence: GAG
gtgcagtggcactgcacagt

SEQ ID NO: 10061 - DNA, 20 bp, Artificial Sequence
  Description of Artificial Sequence: Synthetic oligonucleotide
  Target: ANGPTL3; (+) strand; PAM type: NRG; PAM sequence: GAG
gtggcactgcacagtgagct

SEQ ID NO: 10062 - DNA, 20 bp, Artificial Sequence
  Description of Artificial Sequence: Synthetic oligonucleotide
  Target: ANGPTL3; (+) strand; PAM type: NRG; PAM sequence: CAG
cacagtgagctgagtgatct

SEQ ID NO: 10063 - DNA, 20 bp, Artificial Sequence
  Description of Artificial Sequence: Synthetic oligonucleotide
  Target: ANGPTL3; (+) strand; PAM type: NRG; PAM sequence: TGG
tctctgcaacctccgcctcc

SEQ ID NO: 10064 - DNA, 20 bp, Artificial Sequence
  Description of Artificial Sequence: Synthetic oligonucleotide
  Target: ANGPTL3; (+) strand; PAM type: NRG; PAM sequence: GGG
ctctgcaacctccgcctcct

SEQ ID NO: 10065 - DNA, 20 bp, Artificial Sequence
  Description of Artificial Sequence: Synthetic oligonucleotide
  Target: ANGPTL3; (+) strand; PAM type: NRG; PAM sequence: AAG
aacctccgcctcctgggttc

SEQ ID NO: 10066 - DNA, 20 bp, Artificial Sequence
  Description of Artificial Sequence: Synthetic oligonucleotide
  Target: ANGPTL3; (+) strand; PAM type: NRG; PAM sequence: CAG
ttcaagtgattctcctgcct

SEQ ID NO: 10067 - DNA, 20 bp, Artificial Sequence
  Description of Artificial Sequence: Synthetic oligonucleotide
  Target: ANGPTL3; (+) strand; PAM type: NRG; PAM sequence: GAG
ttctcctgcctcagactcct

SEQ ID NO: 10068 - DNA, 20 bp, Artificial Sequence
  Description of Artificial Sequence: Synthetic oligonucleotide
  Target: ANGPTL3; (+) strand; PAM type: NRG; PAM sequence: TAG
tcctgcctcagactcctgag

SEQ ID NO: 10069 - DNA, 20 bp, Artificial Sequence
  Description of Artificial Sequence: Synthetic oligonucleotide
  Target: ANGPTL3; (+) strand; PAM type: NRG; PAM sequence: TAG
gcctcagactcctgagtagc

SEQ ID NO: 10070 - DNA, 20 bp, Artificial Sequence
  Description of Artificial Sequence: Synthetic oligonucleotide
  Target: ANGPTL3; (+) strand; PAM type: NRG; PAM sequence: AGG
cctcagactcctgagtagct

SEQ ID NO: 10071 - DNA, 20 bp, Artificial Sequence
  Description of Artificial Sequence: Synthetic oligonucleotide
  Target: ANGPTL3; (+) strand; PAM type: NRG; PAM sequence: CAG
ctcctgagtagctaggatta

SEQ ID NO: 10072 - DNA, 20 bp, Artificial Sequence
  Description of Artificial Sequence: Synthetic oligonucleotide
  Target: ANGPTL3; (+) strand; PAM type: NRG; PAM sequence: AGG
tcctgagtagctaggattac

SEQ ID NO: 10073 - DNA, 20 bp, Artificial Sequence
  Description of Artificial Sequence: Synthetic oligonucleotide
  Target: ANGPTL3; (+) strand; PAM type: NRG; PAM sequence: TGG
caggtatgtgccaccatgcc

SEQ ID NO: 10074 - DNA, 20 bp, Artificial Sequence
  Description of Artificial Sequence: Synthetic oligonucleotide
  Target: ANGPTL3; (+) strand; PAM type: NRG; PAM sequence: TAG
ctggctaatttttgtatttt

SEQ ID NO: 10075 - DNA, 20 bp, Artificial Sequence
  Description of Artificial Sequence: Synthetic oligonucleotide
  Target: ANGPTL3; (+) strand; PAM type: NRG; PAM sequence: TAG
gctaatttttgtatttttag

SEQ ID NO: 10076 - DNA, 20 bp, Artificial Sequence
  Description of Artificial Sequence: Synthetic oligonucleotide
  Target: ANGPTL3; (+) strand; PAM type: NRG; PAM sequence: GAG
taatttttgtatttttagta

SEQ ID NO: 10077 - DNA, 20 bp, Artificial Sequence
  Description of Artificial Sequence: Synthetic oligonucleotide
  Target: ANGPTL3; (+) strand; PAM type: NRG; PAM sequence: CGG
ttttgtatttttagtagaga

SEQ ID NO: 10078 - DNA, 20 bp, Artificial Sequence
  Description of Artificial Sequence: Synthetic oligonucleotide
  Target: ANGPTL3; (+) strand; PAM type: NRG; PAM sequence: GAG
ttgtatttttagtagagacg

SEQ ID NO: 10079 - DNA, 20 bp, Artificial Sequence
  Description of Artificial Sequence: Synthetic oligonucleotide
  Target: ANGPTL3; (+) strand; PAM type: NRG; PAM sequence: TGG
gagacggagtttcatcatgt

SEQ ID NO: 10080 - DNA, 20 bp, Artificial Sequence
  Description of Artificial Sequence: Synthetic oligonucleotide
  Target: ANGPTL3; (+) strand; PAM type: NRG; PAM sequence: CAG
cggagtttcatcatgttggt

SEQ ID NO: 10081 - DNA, 20 bp, Artificial Sequence
  Description of Artificial Sequence: Synthetic oligonucleotide
  Target: ANGPTL3; (+) strand; PAM type: NRG; PAM sequence: AGG
ggagtttcatcatgttggtc

SEQ ID NO: 10082 - DNA, 20 bp, Artificial Sequence
  Description of Artificial Sequence: Synthetic oligonucleotide
  Target: ANGPTL3; (+) strand; PAM type: NRG; PAM sequence: TGG
tttcatcatgttggtcaggc

SEQ ID NO: 10083 - DNA, 20 bp, Artificial Sequence
  Description of Artificial Sequence: Synthetic oligonucleotide
  Target: ANGPTL3; (+) strand; PAM type: NRG; PAM sequence: CGG
acctcgtgatccgccttcct

SEQ ID NO: 10084 - DNA, 20 bp, Artificial Sequence
  Description of Artificial Sequence: Synthetic oligonucleotide
  Target: ANGPTL3; (+) strand; PAM type: NRG; PAM sequence: AAG
ccgccttcctcggcctccca

SEQ ID NO: 10085 - DNA, 20 bp, Artificial Sequence
  Description of Artificial Sequence: Synthetic oligonucleotide
  Target: ANGPTL3; (+) strand; PAM type: NRG; PAM sequence: AAG
cctcggcctcccaaagtgct

SEQ ID NO: 10086 - DNA, 20 bp, Artificial Sequence
  Description of Artificial Sequence: Synthetic oligonucleotide
  Target: ANGPTL3; (+) strand; PAM type: NRG; PAM sequence: CAG
ctcccaaagtgctaagatta

SEQ ID NO: 10087 - DNA, 20 bp, Artificial Sequence
  Description of Artificial Sequence: Synthetic oligonucleotide
  Target: ANGPTL3; (+) strand; PAM type: NRG; PAM sequence: AGG
tcccaaagtgctaagattac

SEQ ID NO: 10088 - DNA, 20 bp, Artificial Sequence
  Description of Artificial Sequence: Synthetic oligonucleotide
  Target: ANGPTL3; (+) strand; PAM type: NRG; PAM sequence: GAG
agtgctaagattacaggcgt

SEQ ID NO: 10089 - DNA, 20 bp, Artificial Sequence
  Description of Artificial Sequence: Synthetic oligonucleotide
  Target: ANGPTL3; (+) strand; PAM type: NRG; PAM sequence: CAG
caggcgtgagcccccgcgcc

SEQ ID NO: 10090 - DNA, 20 bp, Artificial Sequence
  Description of Artificial Sequence: Synthetic oligonucleotide
  Target: ANGPTL3; (+) strand; PAM type: NRG; PAM sequence: CAG
gcccccgcgcccagccgact

SEQ ID NO: 10091 - DNA, 20 bp, Artificial Sequence
  Description of Artificial Sequence: Synthetic oligonucleotide
  Target: ANGPTL3; (+) strand; PAM type: NRG; PAM sequence: TAG
cccagccgactcagttttta

SEQ ID NO: 10092 - DNA, 20 bp, Artificial Sequence
  Description of Artificial Sequence: Synthetic oligonucleotide
  Target: ANGPTL3; (+) strand; PAM type: NRG; PAM sequence: TAG
tttttatagttaaaataaac

SEQ ID NO: 10093 - DNA, 20 bp, Artificial Sequence
  Description of Artificial Sequence: Synthetic oligonucleotide
  Target: ANGPTL3; (+) strand; PAM type: NRG; PAM sequence: AGG
ttttatagttaaaataaact

SEQ ID NO: 10094 - DNA, 20 bp, Artificial Sequence
  Description of Artificial Sequence: Synthetic oligonucleotide
  Target: ANGPTL3; (+) strand; PAM type: NRG; PAM sequence: TAG
ataaactaggaccaattcga

SEQ ID NO: 10095 - DNA, 20 bp, Artificial Sequence
  Description of Artificial Sequence: Synthetic oligonucleotide
  Target: ANGPTL3; (+) strand; PAM type: NRG; PAM sequence: CAG
caattcgatagaataaaact

SEQ ID NO: 10096 - DNA, 20 bp, Artificial Sequence
  Description of Artificial Sequence: Synthetic oligonucleotide
  Target: ANGPTL3; (+) strand; PAM type: NRG; PAM sequence: GAG
attcgatagaataaaactca

SEQ ID NO: 10097 - DNA, 20 bp, Artificial Sequence
  Description of Artificial Sequence: Synthetic oligonucleotide
  Target: ANGPTL3; (+) strand; PAM type: NRG; PAM sequence: TGG
cgatagaataaaactcagag

SEQ ID NO: 10098 - DNA, 20 bp, Artificial Sequence
  Description of Artificial Sequence: Synthetic oligonucleotide
  Target: ANGPTL3; (+) strand; PAM type: NRG; PAM sequence: AAG
aaaactcagagtggtataac

SEQ ID NO: 10099 - DNA, 20 bp, Artificial Sequence
  Description of Artificial Sequence: Synthetic oligonucleotide
  Target: ANGPTL3; (+) strand; PAM type: NRG; PAM sequence: AGG
aaactcagagtggtataaca

SEQ ID NO: 10100 - DNA, 20 bp, Artificial Sequence
  Description of Artificial Sequence: Synthetic oligonucleotide
  Target: ANGPTL3; (+) strand; PAM type: NRG; PAM sequence: TAG
taacaaggacaaaaccaaaa

SEQ ID NO: 10101 - DNA, 20 bp, Artificial Sequence
  Description of Artificial Sequence: Synthetic oligonucleotide
  Target: ANGPTL3; (+) strand; PAM type: NRG; PAM sequence: CAG
caaggacaaaaccaaaatag

SEQ ID NO: 10102 - DNA, 20 bp, Artificial Sequence
  Description of Artificial Sequence: Synthetic oligonucleotide
  Target: ANGPTL3; (+) strand; PAM type: NRG; PAM sequence: GAG
aggacaaaaccaaaatagca

SEQ ID NO: 10103 - DNA, 20 bp, Artificial Sequence
  Description of Artificial Sequence: Synthetic oligonucleotide
  Target: ANGPTL3; (+) strand; PAM type: NRG; PAM sequence: TGG
aaccaaaatagcagagtatg

SEQ ID NO: 10104 - DNA, 20 bp, Artificial Sequence
  Description of Artificial Sequence: Synthetic oligonucleotide
  Target: ANGPTL3; (+) strand; PAM type: NRG; PAM sequence: CAG
caaaatagcagagtatgtgg

SEQ ID NO: 10105 - DNA, 20 bp, Artificial Sequence
  Description of Artificial Sequence: Synthetic oligonucleotide
  Target: ANGPTL3; (+) strand; PAM type: NRG; PAM sequence: TAG
aatagcagagtatgtggcag

SEQ ID NO: 10106 - DNA, 20 bp, Artificial Sequence
  Description of Artificial Sequence: Synthetic oligonucleotide
  Target: ANGPTL3; (+) strand; PAM type: NRG; PAM sequence: GAG
agagtatgtggcagtagctt

SEQ ID NO: 10107 - DNA, 20 bp, Artificial Sequence
  Description of Artificial Sequence: Synthetic oligonucleotide
  Target: ANGPTL3; (+) strand; PAM type: NRG; PAM sequence: AAG
acaaaaaccaatactttctg

SEQ ID NO: 10108 - DNA, 20 bp, Artificial Sequence
  Description of Artificial Sequence: Synthetic oligonucleotide
  Target: ANGPTL3; (+) strand; PAM type: NRG; PAM sequence: CAG
aaaaccaatactttctgaag

SEQ ID NO: 10109 - DNA, 20 bp, Artificial Sequence
  Description of Artificial Sequence: Synthetic oligonucleotide
  Target: ANGPTL3; (+) strand; PAM type: NRG; PAM sequence: GAG
aaccaatactttctgaagca

SEQ ID NO: 10110 - DNA, 20 bp, Artificial Sequence
  Description of Artificial Sequence: Synthetic oligonucleotide
  Target: ANGPTL3; (+) strand; PAM type: NRG; PAM sequence: TAG
cagagaaccatacacttgaa

SEQ ID NO: 10111 - DNA, 20 bp, Artificial Sequence
  Description of Artificial Sequence: Synthetic oligonucleotide
  Target: ANGPTL3; (+) strand; PAM type: NRG; PAM sequence: CAG
aaaaaatgctcctgaatttt

SEQ ID NO: 10112 - DNA, 20 bp, Artificial Sequence
  Description of Artificial Sequence: Synthetic oligonucleotide
  Target: ANGPTL3; (+) strand; PAM type: NRG; PAM sequence: CAG
cctgaattttcagtaacgtt

SEQ ID NO: 10113 - DNA, 20 bp, Artificial Sequence
  Description of Artificial Sequence: Synthetic oligonucleotide
  Target: ANGPTL3; (+) strand; PAM type: NRG; PAM sequence: TAG
acttccttaaattatgaatg

SEQ ID NO: 10114 - DNA, 20 bp, Artificial Sequence
  Description of Artificial Sequence: Synthetic oligonucleotide
  Target: ANGPTL3; (+) strand; PAM type: NRG; PAM sequence: CAG
tgaatgtagtaaaccaacca

SEQ ID NO: 10115 - DNA, 20 bp, Artificial Sequence
  Description of Artificial Sequence: Synthetic oligonucleotide
  Target: ANGPTL3; (+) strand; PAM type: NRG; PAM sequence: CAG
atgtagtaaaccaaccacag

SEQ ID NO: 10116 - DNA, 20 bp, Artificial Sequence
  Description of Artificial Sequence: Synthetic oligonucleotide
  Target: ANGPTL3; (+) strand; PAM type: NRG; PAM sequence: CAG
accaaccacagcagtattac

SEQ ID NO: 10117 - DNA, 20 bp, Artificial Sequence
  Description of Artificial Sequence: Synthetic oligonucleotide
  Target: ANGPTL3; (+) strand; PAM type: NRG; PAM sequence: AAG
cagcagtattaccagtatat

SEQ ID NO: 10118 - DNA, 20 bp, Artificial Sequence
  Description of Artificial Sequence: Synthetic oligonucleotide
  Target: ANGPTL3; (+) strand; PAM type: NRG; PAM sequence: TAG
atataagattttgtcattaa

SEQ ID NO: 10119 - DNA, 20 bp, Artificial Sequence
  Description of Artificial Sequence: Synthetic oligonucleotide
  Target: ANGPTL3; (+) strand; PAM type: NRG; PAM sequence: AAG
tattattattattatacttt

SEQ ID NO: 10120 - DNA, 20 bp, Artificial Sequence
  Description of Artificial Sequence: Synthetic oligonucleotide
  Target: ANGPTL3; (+) strand; PAM type: NRG; PAM sequence: TGG
tattattatactttaagttc

SEQ ID NO: 10121 - DNA, 20 bp, Artificial Sequence
  Description of Artificial Sequence: Synthetic oligonucleotide
  Target: ANGPTL3; (+) strand; PAM type: NRG; PAM sequence: GGG
attattatactttaagttct

SEQ ID NO: 10122 - DNA, 20 bp, Artificial Sequence
  Description of Artificial Sequence: Synthetic oligonucleotide
  Target: ANGPTL3; (+) strand; PAM type: NRG; PAM sequence: CAG
taagttctgggatacatgcg

SEQ ID NO: 10123 - DNA, 20 bp, Artificial Sequence
  Description of Artificial Sequence: Synthetic oligonucleotide
  Target: ANGPTL3; (+) strand; PAM type: NRG; PAM sequence: CAG
ggatacatgcgcagaacgtg

SEQ ID NO: 10124 - DNA, 20 bp, Artificial Sequence
  Description of Artificial Sequence: Synthetic oligonucleotide
  Target: ANGPTL3; (+) strand; PAM type: NRG; PAM sequence: TAG
gaacgtgcagttttgttaca

SEQ ID NO: 10125 - DNA, 20 bp, Artificial Sequence
  Description of Artificial Sequence: Synthetic oligonucleotide
  Target: ANGPTL3; (+) strand; PAM type: NRG; PAM sequence: AGG
aacgtgcagttttgttacat

SEQ ID NO: 10126 - DNA, 20 bp, Artificial Sequence
  Description of Artificial Sequence: Synthetic oligonucleotide
  Target: ANGPTL3; (+) strand; PAM type: NRG; PAM sequence: TGG
ttgttacataggtatacacg

SEQ ID NO: 10127 - DNA, 20 bp, Artificial Sequence
  Description of Artificial Sequence: Synthetic oligonucleotide
  Target: ANGPTL3; (+) strand; PAM type: NRG; PAM sequence: TGG
acataggtatacacgtggta

SEQ ID NO: 10128 - DNA, 20 bp, Artificial Sequence
  Description of Artificial Sequence: Synthetic oligonucleotide
  Target: ANGPTL3; (+) strand; PAM type: NRG; PAM sequence: TGG
taggtatacacgtggtatgg

SEQ ID NO: 10129 - DNA, 20 bp, Artificial Sequence
  Description of Artificial Sequence: Synthetic oligonucleotide
  Target: ANGPTL3; (+) strand; PAM type: NRG; PAM sequence: TAG
catcaacccgtcatctacat

SEQ ID NO: 10130 - DNA, 20 bp, Artificial Sequence
  Description of Artificial Sequence: Synthetic oligonucleotide
  Target: ANGPTL3; (+) strand; PAM type: NRG; PAM sequence: AGG
atcaacccgtcatctacatt

SEQ ID NO: 10131 - DNA, 20 bp, Artificial Sequence
  Description of Artificial Sequence: Synthetic oligonucleotide
  Target: ANGPTL3; (+) strand; PAM type: NRG; PAM sequence: TAG
tcctaatgctatccctcccc

SEQ ID NO: 10132 - DNA, 20 bp, Artificial Sequence
  Description of Artificial Sequence: Synthetic oligonucleotide
  Target: ANGPTL3; (+) strand; PAM type: NRG; PAM sequence: CAG
ctcccctagccccaccccga

SEQ ID NO: 10133 - DNA, 20 bp, Artificial Sequence
  Description of Artificial Sequence: Synthetic oligonucleotide
  Target: ANGPTL3; (+) strand; PAM type: NRG; PAM sequence: AGG
tcccctagccccaccccgac

SEQ ID NO: 10134 - DNA, 20 bp, Artificial Sequence
  Description of Artificial Sequence: Synthetic oligonucleotide
  Target: ANGPTL3; (+) strand; PAM type: NRG; PAM sequence: CAG
agccccaccccgacaggtcc

SEQ ID NO: 10135 - DNA, 20 bp, Artificial Sequence
  Description of Artificial Sequence: Synthetic oligonucleotide
  Target: ANGPTL3; (+) strand; PAM type: NRG; PAM sequence: TAG
gtccatgtgttctcattgtt

SEQ ID NO: 10136 - DNA, 20 bp, Artificial Sequence
  Description of Artificial Sequence: Synthetic oligonucleotide
  Target: ANGPTL3; (+) strand; PAM type: NRG; PAM sequence: GAG
attgtttagctcccacttat

SEQ ID NO: 10137 - DNA, 20 bp, Artificial Sequence
  Description of Artificial Sequence: Synthetic oligonucleotide
  Target: ANGPTL3; (+) strand; PAM type: NRG; PAM sequence: GAG
tttagctcccacttatgagt

SEQ ID NO: 10138 - DNA, 20 bp, Artificial Sequence
  Description of Artificial Sequence: Synthetic oligonucleotide
  Target: ANGPTL3; (+) strand; PAM type: NRG; PAM sequence: TGG
cacttatgagtgagaacatg

SEQ ID NO: 10139 - DNA, 20 bp, Artificial Sequence
  Description of Artificial Sequence: Synthetic oligonucleotide
  Target: ANGPTL3; (+) strand; PAM type: NRG; PAM sequence: TGG
gagtgagaacatgtggtgtt

SEQ ID NO: 10140 - DNA, 20 bp, Artificial Sequence
  Description of Artificial Sequence: Synthetic oligonucleotide
  Target: ANGPTL3; (+) strand; PAM type: NRG; PAM sequence: TAG
ttggttttctgttcctgtgt

SEQ ID NO: 10141 - DNA, 20 bp, Artificial Sequence
  Description of Artificial Sequence: Synthetic oligonucleotide
  Target: ANGPTL3; (+) strand; PAM type: NRG; PAM sequence: GAG
tgttcctgtgttagtttgct

SEQ ID NO: 10142 - DNA, 20 bp, Artificial Sequence
  Description of Artificial Sequence: Synthetic oligonucleotide
  Target: ANGPTL3; (+) strand; PAM type: NRG; PAM sequence: TGG
tgttagtttgctgagaatga

SEQ ID NO: 10143 - DNA, 20 bp, Artificial Sequence
  Description of Artificial Sequence: Synthetic oligonucleotide
  Target: ANGPTL3; (+) strand; PAM type: NRG; PAM sequence: CAG
ttgctgagaatgatggtttc

SEQ ID NO: 10144 - DNA, 20 bp, Artificial Sequence
  Description of Artificial Sequence: Synthetic oligonucleotide
  Target: ANGPTL3; (+) strand; PAM type: NRG; PAM sequence: AAG
gcttcatccatgtccctaca

SEQ ID NO: 10145 - DNA, 20 bp, Artificial Sequence
  Description of Artificial Sequence: Synthetic oligonucleotide
  Target: ANGPTL3; (+) strand; PAM type: NRG; PAM sequence: AGG
cttcatccatgtccctacaa

SEQ ID NO: 10146 - DNA, 20 bp, Artificial Sequence
  Description of Artificial Sequence: Synthetic oligonucleotide
  Target: ANGPTL3; (+) strand; PAM type: NRG; PAM sequence: TGG
catgaactcatcctttttta

SEQ ID NO: 10147 - DNA, 20 bp, Artificial Sequence
  Description of Artificial Sequence: Synthetic oligonucleotide
  Target: ANGPTL3; (+) strand; PAM type: NRG; PAM sequence: TAG
catccttttttatggctgca

SEQ ID NO: 10148 - DNA, 20 bp, Artificial Sequence
  Description of Artificial Sequence: Synthetic oligonucleotide
  Target: ANGPTL3; (+) strand; PAM type: NRG; PAM sequence: TGG
tatggctgcatagtattcca

SEQ ID NO: 10149 - DNA, 20 bp, Artificial Sequence
  Description of Artificial Sequence: Synthetic oligonucleotide
  Target: ANGPTL3; (+) strand; PAM type: NRG; PAM sequence: CAG
tgtgccacattttcttcatc

SEQ ID NO: 10150 - DNA, 20 bp, Artificial Sequence
  Description of Artificial Sequence: Synthetic oligonucleotide
  Target: ANGPTL3; (+) strand; PAM type: NRG; PAM sequence: TGG
ttcatccagtctatcattga

SEQ ID NO: 10151 - DNA, 20 bp, Artificial Sequence
  Description of Artificial Sequence: Synthetic oligonucleotide
  Target: ANGPTL3; (+) strand; PAM type: NRG; PAM sequence: GGG
tcatccagtctatcattgat

SEQ ID NO: 10152 - DNA, 20 bp, Artificial Sequence
  Description of Artificial Sequence: Synthetic oligonucleotide
  Target: ANGPTL3; (+) strand; PAM type: NRG; PAM sequence: TGG
gtctatcattgatgggcatt

SEQ ID NO: 10153 - DNA, 20 bp, Artificial Sequence
  Description of Artificial Sequence: Synthetic oligonucleotide
  Target: ANGPTL3; (+) strand; PAM type: NRG; PAM sequence: GGG
tctatcattgatgggcattt

SEQ ID NO: 10154 - DNA, 20 bp, Artificial Sequence
  Description of Artificial Sequence: Synthetic oligonucleotide
  Target: ANGPTL3; (+) strand; PAM type: NRG; PAM sequence: TGG
tcattgatgggcatttgggt

SEQ ID NO: 10155 - DNA, 20 bp, Artificial Sequence
  Description of Artificial Sequence: Synthetic oligonucleotide
  Target: ANGPTL3; (+) strand; PAM type: NRG; PAM sequence: AAG
tgggcatttgggttggttcc

SEQ ID NO: 10156 - DNA, 20 bp, Artificial Sequence
  Description of Artificial Sequence: Synthetic oligonucleotide
  Target: ANGPTL3; (+) strand; PAM type: NRG; PAM sequence: TAG
caagtctttgttattgtgaa

SEQ ID NO: 10157 - DNA, 20 bp, Artificial Sequence
  Description of Artificial Sequence: Synthetic oligonucleotide
  Target: ANGPTL3; (+) strand; PAM type: NRG; PAM sequence: TAG
catgtgtgcatgtgtcttta

SEQ ID NO: 10158 - DNA, 20 bp, Artificial Sequence
  Description of Artificial Sequence: Synthetic oligonucleotide
  Target: ANGPTL3; (+) strand; PAM type: NRG; PAM sequence: TAG
gtgtgcatgtgtctttatag

SEQ ID NO: 10159 - DNA, 20 bp, Artificial Sequence
  Description of Artificial Sequence: Synthetic oligonucleotide
  Target: ANGPTL3; (+) strand; PAM type: NRG; PAM sequence: TGG
tttgaatatatacccaataa

SEQ ID NO: 10160 - DNA, 20 bp, Artificial Sequence
  Description of Artificial Sequence: Synthetic oligonucleotide
  Target: ANGPTL3; (+) strand; PAM type: NRG; PAM sequence: GGG
ttgaatatatacccaataat

SEQ ID NO: 10161 - DNA, 20 bp, Artificial Sequence
  Description of Artificial Sequence: Synthetic oligonucleotide
  Target: ANGPTL3; (+) strand; PAM type: NRG; PAM sequence: TGG
atacccaataatgggattac

SEQ ID NO: 10162 - DNA, 20 bp, Artificial Sequence
  Description of Artificial Sequence: Synthetic oligonucleotide
  Target: ANGPTL3; (+) strand; PAM type: NRG; PAM sequence: GGG
tacccaataatgggattact

SEQ ID NO: 10163 - DNA, 20 bp, Artificial Sequence
  Description of Artificial Sequence: Synthetic oligonucleotide
  Target: ANGPTL3; (+) strand; PAM type: NRG; PAM sequence: TGG
aatgggattactgggtcaaa

SEQ ID NO: 10164 - DNA, 20 bp, Artificial Sequence
  Description of Artificial Sequence: Synthetic oligonucleotide
  Target: ANGPTL3; (+) strand; PAM type: NRG; PAM sequence: TAG
actgggtcaaatggtatttc

SEQ ID NO: 10165 - DNA, 20 bp, Artificial Sequence
  Description of Artificial Sequence: Synthetic oligonucleotide
  Target: ANGPTL3; (+) strand; PAM type: NRG; PAM sequence: TAG
tcaaatggtatttctagttc

SEQ ID NO: 10166 - DNA, 20 bp, Artificial Sequence
  Description of Artificial Sequence: Synthetic oligonucleotide
  Target: ANGPTL3; (+) strand; PAM type: NRG; PAM sequence: GAG
atttctagttctagttcctt

SEQ ID NO: 10167 - DNA, 20 bp, Artificial Sequence
  Description of Artificial Sequence: Synthetic oligonucleotide
  Target: ANGPTL3; (+) strand; PAM type: NRG; PAM sequence: AGG
tttctagttctagttccttg

SEQ ID NO: 10168 - DNA, 20 bp, Artificial Sequence
  Description of Artificial Sequence: Synthetic oligonucleotide
  Target: ANGPTL3; (+) strand; PAM type: NRG; PAM sequence: TGG
cgccacactgtcttccacaa

SEQ ID NO: 10169 - DNA, 20 bp, Artificial Sequence
  Description of Artificial Sequence: Synthetic oligonucleotide
  Target: ANGPTL3; (+) strand; PAM type: NRG; PAM sequence: TAG
tttttatatcacaactatta

SEQ ID NO: 10170 - DNA, 20 bp, Artificial Sequence
  Description of Artificial Sequence: Synthetic oligonucleotide
  Target: ANGPTL3; (+) strand; PAM type: NRG; PAM sequence: TAG
tgttgatgcttattactatt

SEQ ID NO: 10171 - DNA, 20 bp, Artificial Sequence
  Description of Artificial Sequence: Synthetic oligonucleotide
  Target: ANGPTL3; (+) strand; PAM type: NRG; PAM sequence: TAG
ttactatttagaaaatacaa

SEQ ID NO: 10172 - DNA, 20 bp, Artificial Sequence
  Description of Artificial Sequence: Synthetic oligonucleotide
  Target: ANGPTL3; (-) strand; PAM type: YTN; PAM sequence: CTC
ctgcgtttatggtatcactt

SEQ ID NO: 10173 - DNA, 20 bp, Artificial Sequence
  Description of Artificial Sequence: Synthetic oligonucleotide
  Target: ANGPTL3; (-) strand; PAM type: YTN; PAM sequence: TTC
ctcctgcgtttatggtatca

SEQ ID NO: 10174 - DNA, 20 bp, Artificial Sequence
  Description of Artificial Sequence: Synthetic oligonucleotide
  Target: ANGPTL3; (-) strand; PAM type: YTN; PAM sequence: CTT
cctcctgcgtttatggtatc

SEQ ID NO: 10175 - DNA, 20 bp, Artificial Sequence
  Description of Artificial Sequence: Synthetic oligonucleotide
  Target: ANGPTL3; (-) strand; PAM type: YTN; PAM sequence: TTC
ttcctcctgcgtttatggta

SEQ ID NO: 10176 - DNA, 20 bp, Artificial Sequence
  Description of Artificial Sequence: Synthetic oligonucleotide
  Target: ANGPTL3; (-) strand; PAM type: YTN; PAM sequence: TTT
cttcctcctgcgtttatggt

SEQ ID NO: 10177 - DNA, 20 bp, Artificial Sequence
  Description of Artificial Sequence: Synthetic oligonucleotide
  Target: ANGPTL3; (-) strand; PAM type: YTN; PAM sequence: TTT
tcttcctcctgcgtttatgg

SEQ ID NO: 10178 - DNA, 20 bp, Artificial Sequence
  Description of Artificial Sequence: Synthetic oligonucleotide
  Target: ANGPTL3; (-) strand; PAM type: YTN; PAM sequence: TTG
tcattttcttcctcctgcgt

SEQ ID NO: 10179 - DNA, 20 bp, Artificial Sequence
  Description of Artificial Sequence: Synthetic oligonucleotide
  Target: ANGPTL3; (-) strand; PAM type: YTN; PAM sequence: TTT
gtcattttcttcctcctgcg

SEQ ID NO: 10180 - DNA, 20 bp, Artificial Sequence
  Description of Artificial Sequence: Synthetic oligonucleotide
  Target: ANGPTL3; (-) strand; PAM type: YTN; PAM sequence: TTC
agtttgtcattttcttcctc

SEQ ID NO: 10181 - DNA, 20 bp, Artificial Sequence
  Description of Artificial Sequence: Synthetic oligonucleotide
  Target: ANGPTL3; (-) strand; PAM type: YTN; PAM sequence: TTT
cagtttgtcattttcttcct

SEQ ID NO: 10182 - DNA, 20 bp, Artificial Sequence
  Description of Artificial Sequence: Synthetic oligonucleotide
  Target: ANGPTL3; (-) strand; PAM type: YTN; PAM sequence: TTT
tcagtttgtcattttcttcc

SEQ ID NO: 10183 - DNA, 20 bp, Artificial Sequence
  Description of Artificial Sequence: Synthetic oligonucleotide
  Target: ANGPTL3; (-) strand; PAM type: YTN; PAM sequence: TTT
ttcagtttgtcattttcttc

SEQ ID NO: 10184 - DNA, 20 bp, Artificial Sequence
  Description of Artificial Sequence: Synthetic oligonucleotide
  Target: ANGPTL3; (-) strand; PAM type: YTN; PAM sequence: TTT
tttcagtttgtcattttctt

SEQ ID NO: 10185 - DNA, 20 bp, Artificial Sequence
  Description of Artificial Sequence: Synthetic oligonucleotide
  Target: ANGPTL3; (-) strand; PAM type: YTN; PAM sequence: TTA
tatatataacaaacaataga

SEQ ID NO: 10186 - DNA, 20 bp, Artificial Sequence
  Description of Artificial Sequence: Synthetic oligonucleotide
  Target: ANGPTL3; (-) strand; PAM type: YTN; PAM sequence: TTG
ttatatatataacaaacaat

SEQ ID NO: 10187 - DNA, 20 bp, Artificial Sequence
  Description of Artificial Sequence: Synthetic oligonucleotide
  Target: ANGPTL3; (-) strand; PAM type: YTN; PAM sequence: TTT
gttatatatataacaaacaa

SEQ ID NO: 10188 - DNA, 20 bp, Artificial Sequence
  Description of Artificial Sequence: Synthetic oligonucleotide
  Target: ANGPTL3; (-) strand; PAM type: YTN; PAM sequence: CTT
tgttatatatataacaaaca

SEQ ID NO: 10189 - DNA, 20 bp, Artificial Sequence
  Description of Artificial Sequence: Synthetic oligonucleotide
  Target: ANGPTL3; (-) strand; PAM type: YTN; PAM sequence: TTC
tttgttatatatataacaaa

SEQ ID NO: 10190 - DNA, 20 bp, Artificial Sequence
  Description of Artificial Sequence: Synthetic oligonucleotide
  Target: ANGPTL3; (-) strand; PAM type: YTN; PAM sequence: CTA
attctttgttatatatataa

SEQ ID NO: 10191 - DNA, 20 bp, Artificial Sequence
  Description of Artificial Sequence: Synthetic oligonucleotide
  Target: ANGPTL3; (-) strand; PAM type: YTN; PAM sequence: TTG
tggatactaattctttgtta

SEQ ID NO: 10192 - DNA, 20 bp, Artificial Sequence
  Description of Artificial Sequence: Synthetic oligonucleotide
  Target: ANGPTL3; (-) strand; PAM type: YTN; PAM sequence: TTA
catattgtggatactaattc

SEQ ID NO: 10193 - DNA, 20 bp, Artificial Sequence
  Description of Artificial Sequence: Synthetic oligonucleotide
  Target: ANGPTL3; (-) strand; PAM type: YTN; PAM sequence: TTT
acatattgtggatactaatt

SEQ ID NO: 10194 - DNA, 20 bp, Artificial Sequence
  Description of Artificial Sequence: Synthetic oligonucleotide
  Target: ANGPTL3; (-) strand; PAM type: YTN; PAM sequence: TTA
tttacatattgtggatacta

SEQ ID NO: 10195 - DNA, 20 bp, Artificial Sequence
  Description of Artificial Sequence: Synthetic oligonucleotide
  Target: ANGPTL3; (-) strand; PAM type: YTN; PAM sequence: TTA
ggaattatttacatattgtg

SEQ ID NO: 10196 - DNA, 20 bp, Artificial Sequence
  Description of Artificial Sequence: Synthetic oligonucleotide
  Target: ANGPTL3; (-) strand; PAM type: YTN; PAM sequence: TTT
aggaattatttacatattgt

SEQ ID NO: 10197 - DNA, 20 bp, Artificial Sequence
  Description of Artificial Sequence: Synthetic oligonucleotide
  Target: ANGPTL3; (-) strand; PAM type: YTN; PAM sequence: TTT
taggaattatttacatattg

SEQ ID NO: 10198 - DNA, 20 bp, Artificial Sequence
  Description of Artificial Sequence: Synthetic oligonucleotide
  Target: ANGPTL3; (-) strand; PAM type: YTN; PAM sequence: CTA
attttaggaattatttacat

SEQ ID NO: 10199 - DNA, 20 bp, Artificial Sequence
  Description of Artificial Sequence: Synthetic oligonucleotide
  Target: ANGPTL3; (-) strand; PAM type: YTN; PAM sequence: CTG
actaattttaggaattattt

SEQ ID NO: 10200 - DNA, 20 bp, Artificial Sequence
  Description of Artificial Sequence: Synthetic oligonucleotide
  Target: ANGPTL3; (-) strand; PAM type: YTN; PAM sequence: TTC
tgactaattttaggaattat

SEQ ID NO: 10201 - DNA, 20 bp, Artificial Sequence
  Description of Artificial Sequence: Synthetic oligonucleotide
  Target: ANGPTL3; (-) strand; PAM type: YTN; PAM sequence: TTT
ctgactaattttaggaatta

SEQ ID NO: 10202 - DNA, 20 bp, Artificial Sequence
  Description of Artificial Sequence: Synthetic oligonucleotide
  Target: ANGPTL3; (-) strand; PAM type: YTN; PAM sequence: CTT
tctgactaattttaggaatt

SEQ ID NO: 10203 - DNA, 20 bp, Artificial Sequence
  Description of Artificial Sequence: Synthetic oligonucleotide
  Target: ANGPTL3; (-) strand; PAM type: YTN; PAM sequence: CTC
tttctgactaattttaggaa

SEQ ID NO: 10204 - DNA, 20 bp, Artificial Sequence
  Description of Artificial Sequence: Synthetic oligonucleotide
  Target: ANGPTL3; (-) strand; PAM type: YTN; PAM sequence: TTG
tctctttctgactaatttta

SEQ ID NO: 10205 - DNA, 20 bp, Artificial Sequence
  Description of Artificial Sequence: Synthetic oligonucleotide
  Target: ANGPTL3; (-) strand; PAM type: YTN; PAM sequence: TTT
gtctctttctgactaatttt

SEQ ID NO: 10206 - DNA, 20 bp, Artificial Sequence
  Description of Artificial Sequence: Synthetic oligonucleotide
  Target: ANGPTL3; (-) strand; PAM type: YTN; PAM sequence: TTA
agtttgtctctttctgacta

SEQ ID NO: 10207 - DNA, 20 bp, Artificial Sequence
  Description of Artificial Sequence: Synthetic oligonucleotide
  Target: ANGPTL3; (-) strand; PAM type: YTN; PAM sequence: TTT
aagtttgtctctttctgact

SEQ ID NO: 10208 - DNA, 20 bp, Artificial Sequence
  Description of Artificial Sequence: Synthetic oligonucleotide
  Target: ANGPTL3; (-) strand; PAM type: YTN; PAM sequence: TTT
taagtttgtctctttctgac

SEQ ID NO: 10209 - DNA, 20 bp, Artificial Sequence
  Description of Artificial Sequence: Synthetic oligonucleotide
  Target: ANGPTL3; (-) strand; PAM type: YTN; PAM sequence: TTT
ttaagtttgtctctttctga

SEQ ID NO: 10210 - DNA, 20 bp, Artificial Sequence
  Description of Artificial Sequence: Synthetic oligonucleotide
  Target: ANGPTL3; (-) strand; PAM type: YTN; PAM sequence: CTT
tttaagtttgtctctttctg

SEQ ID NO: 10211 - DNA, 20 bp, Artificial Sequence
  Description of Artificial Sequence: Synthetic oligonucleotide
  Target: ANGPTL3; (-) strand; PAM type: YTN; PAM sequence: CTC
tttttaagtttgtctctttc

SEQ ID NO: 10212 - DNA, 20 bp, Artificial Sequence
  Description of Artificial Sequence: Synthetic oligonucleotide
  Target: ANGPTL3; (-) strand; PAM type: YTN; PAM sequence: TTA
ccctctttttaagtttgtct

SEQ ID NO: 10213 - DNA, 20 bp, Artificial Sequence
  Description of Artificial Sequence: Synthetic oligonucleotide
  Target: ANGPTL3; (-) strand; PAM type: YTN; PAM sequence: TTG
ttaccctctttttaagtttg

SEQ ID NO: 10214 - DNA, 20 bp, Artificial Sequence
  Description of Artificial Sequence: Synthetic oligonucleotide
  Target: ANGPTL3; (-) strand; PAM type: YTN; PAM sequence: CTT
gttaccctctttttaagttt

SEQ ID NO: 10215 - DNA, 20 bp, Artificial Sequence
  Description of Artificial Sequence: Synthetic oligonucleotide
  Target: ANGPTL3; (-) strand; PAM type: YTN; PAM sequence: CTC
cttgttaccctctttttaag

SEQ ID NO: 10216 - DNA, 20 bp, Artificial Sequence
  Description of Artificial Sequence: Synthetic oligonucleotide
  Target: ANGPTL3; (-) strand; PAM type: YTN; PAM sequence: CTC
ccctccttgttaccctcttt

SEQ ID NO: 10217 - DNA, 20 bp, Artificial Sequence
  Description of Artificial Sequence: Synthetic oligonucleotide
  Target: ANGPTL3; (-) strand; PAM type: YTN; PAM sequence: TTG
ctcccctccttgttaccctc

SEQ ID NO: 10218 - DNA, 20 bp, Artificial Sequence
  Description of Artificial Sequence: Synthetic oligonucleotide
  Target: ANGPTL3; (-) strand; PAM type: YTN; PAM sequence: TTT
gctcccctccttgttaccct

SEQ ID NO: 10219 - DNA, 20 bp, Artificial Sequence
  Description of Artificial Sequence: Synthetic oligonucleotide
  Target: ANGPTL3; (-) strand; PAM type: YTN; PAM sequence: TTA
tgtacataatttgctcccct

SEQ ID NO: 10220 - DNA, 20 bp, Artificial Sequence
  Description of Artificial Sequence: Synthetic oligonucleotide
  Target: ANGPTL3; (-) strand; PAM type: YTN; PAM sequence: CTG
gttatgtacataatttgctc

SEQ ID NO: 10221 - DNA, 20 bp, Artificial Sequence
  Description of Artificial Sequence: Synthetic oligonucleotide
  Target: ANGPTL3; (-) strand; PAM type: YTN; PAM sequence: TTG
cgaatcatctggttatgtac

SEQ ID NO: 10222 - DNA, 20 bp, Artificial Sequence
  Description of Artificial Sequence: Synthetic oligonucleotide
  Target: ANGPTL3; (-) strand; PAM type: YTN; PAM sequence: TTT
gcgaatcatctggttatgta

SEQ ID NO: 10223 - DNA, 20 bp, Artificial Sequence
  Description of Artificial Sequence: Synthetic oligonucleotide
  Target: ANGPTL3; (-) strand; PAM type: YTN; PAM sequence: CTT
tgcgaatcatctggttatgt

SEQ ID NO: 10224 - DNA, 20 bp, Artificial Sequence
  Description of Artificial Sequence: Synthetic oligonucleotide
  Target: ANGPTL3; (-) strand; PAM type: YTN; PAM sequence: TTG
ccgtctttgcgaatcatctg

SEQ ID NO: 10225 - DNA, 20 bp, Artificial Sequence
  Description of Artificial Sequence: Synthetic oligonucleotide
  Target: ANGPTL3; (-) strand; PAM type: YTN; PAM sequence: CTG
ttgccgtctttgcgaatcat

SEQ ID NO: 10226 - DNA, 20 bp, Artificial Sequence
  Description of Artificial Sequence: Synthetic oligonucleotide
  Target: ANGPTL3; (-) strand; PAM type: YTN; PAM sequence: CTC
tgttgccgtctttgcgaatc

SEQ ID NO: 10227 - DNA, 20 bp, Artificial Sequence
  Description of Artificial Sequence: Synthetic oligonucleotide
  Target: ANGPTL3; (-) strand; PAM type: YTN; PAM sequence: CTG
gccatctctgttgccgtctt

SEQ ID NO: 10228 - DNA, 20 bp, Artificial Sequence
  Description of Artificial Sequence: Synthetic oligonucleotide
  Target: ANGPTL3; (-) strand; PAM type: YTN; PAM sequence: TTG
ctggccatctctgttgccgt

SEQ ID NO: 10229 - DNA, 20 bp, Artificial Sequence
  Description of Artificial Sequence: Synthetic oligonucleotide
  Target: ANGPTL3; (-) strand; PAM type: YTN; PAM sequence: TTT
gctggccatctctgttgccg

SEQ ID NO: 10230 - DNA, 20 bp, Artificial Sequence
  Description of Artificial Sequence: Synthetic oligonucleotide
  Target: ANGPTL3; (-) strand; PAM type: YTN; PAM sequence: TTT
tgctggccatctctgttgcc

SEQ ID NO: 10231 - DNA, 20 bp, Artificial Sequence
  Description of Artificial Sequence: Synthetic oligonucleotide
  Target: ANGPTL3; (-) strand; PAM type: YTN; PAM sequence: TTG
ttttgctggccatctctgtt

SEQ ID NO: 10232 - DNA, 20 bp, Artificial Sequence
  Description of Artificial Sequence: Synthetic oligonucleotide
  Target: ANGPTL3; (-) strand; PAM type: YTN; PAM sequence: TTT
gttttgctggccatctctgt

SEQ ID NO: 10233 - DNA, 20 bp, Artificial Sequence
  Description of Artificial Sequence: Synthetic oligonucleotide
  Target: ANGPTL3; (-) strand; PAM type: YTN; PAM sequence: CTA
gtttgttttgctggccatct

SEQ ID NO: 10234 - DNA, 20 bp, Artificial Sequence
  Description of Artificial Sequence: Synthetic oligonucleotide
  Target: ANGPTL3; (-) strand; PAM type: YTN; PAM sequence: CTA
atagacaagtatatatctag

SEQ ID NO: 10235 - DNA, 20 bp, Artificial Sequence
  Description of Artificial Sequence: Synthetic oligonucleotide
  Target: ANGPTL3; (-) strand; PAM type: YTN; PAM sequence: TTG
ataaatctaatagacaagta

SEQ ID NO: 10236 - DNA, 20 bp, Artificial Sequence
  Description of Artificial Sequence: Synthetic oligonucleotide
  Target: ANGPTL3; (-) strand; PAM type: YTN; PAM sequence: TTA
atgaaaaaggcaaaaaatgt

SEQ ID NO: 10237 - DNA, 20 bp, Artificial Sequence
  Description of Artificial Sequence: Synthetic oligonucleotide
  Target: ANGPTL3; (-) strand; PAM type: YTN; PAM sequence: TTT
aatgaaaaaggcaaaaaatg

SEQ ID NO: 10238 - DNA, 20 bp, Artificial Sequence
  Description of Artificial Sequence: Synthetic oligonucleotide
  Target: ANGPTL3; (-) strand; PAM type: YTN; PAM sequence: TTT
taatgaaaaaggcaaaaaat

SEQ ID NO: 10239 - DNA, 20 bp, Artificial Sequence
  Description of Artificial Sequence: Synthetic oligonucleotide
  Target: ANGPTL3; (-) strand; PAM type: YTN; PAM sequence: CTT
ttaatgaaaaaggcaaaaaa

SEQ ID NO: 10240 - DNA, 20 bp, Artificial Sequence
  Description of Artificial Sequence: Synthetic oligonucleotide
  Target: ANGPTL3; (-) strand; PAM type: YTN; PAM sequence: TTA
caaatgcttttaatgaaaaa

SEQ ID NO: 10241 - DNA, 20 bp, Artificial Sequence
  Description of Artificial Sequence: Synthetic oligonucleotide
  Target: ANGPTL3; (-) strand; PAM type: YTN; PAM sequence: TTT
acaaatgcttttaatgaaaa

SEQ ID NO: 10242 - DNA, 20 bp, Artificial Sequence
  Description of Artificial Sequence: Synthetic oligonucleotide
  Target: ANGPTL3; (-) strand; PAM type: YTN; PAM sequence: TTT
tacaaatgcttttaatgaaa

SEQ ID NO: 10243 - DNA, 20 bp, Artificial Sequence
  Description of Artificial Sequence: Synthetic oligonucleotide
  Target: ANGPTL3; (-) strand; PAM type: YTN; PAM sequence: CTT
ttacaaatgcttttaatgaa

SEQ ID NO: 10244 - DNA, 20 bp, Artificial Sequence
  Description of Artificial Sequence: Synthetic oligonucleotide
  Target: ANGPTL3; (-) strand; PAM type: YTN; PAM sequence: CTA
tatccttttacaaatgcttt

SEQ ID NO: 10245 - DNA, 20 bp, Artificial Sequence
  Description of Artificial Sequence: Synthetic oligonucleotide
  Target: ANGPTL3; (-) strand; PAM type: YTN; PAM sequence: TTC
ctatatccttttacaaatgc

SEQ ID NO: 10246 - DNA, 20 bp, Artificial Sequence
  Description of Artificial Sequence: Synthetic oligonucleotide
  Target: ANGPTL3; (-) strand; PAM type: YTN; PAM sequence: TTT
cctatatccttttacaaatg

SEQ ID NO: 10247 - DNA, 20 bp, Artificial Sequence
  Description of Artificial Sequence: Synthetic oligonucleotide
  Target: ANGPTL3; (-) strand; PAM type: YTN; PAM sequence: TTT
tcctatatccttttacaaat

SEQ ID NO: 10248 - DNA, 20 bp, Artificial Sequence
  Description of Artificial Sequence: Synthetic oligonucleotide
  Target: ANGPTL3; (-) strand; PAM type: YTN; PAM sequence: CTT
ttcctatatccttttacaaa

SEQ ID NO: 10249 - DNA, 20 bp, Artificial Sequence
  Description of Artificial Sequence: Synthetic oligonucleotide
  Target: ANGPTL3; (-) strand; PAM type: YTN; PAM sequence: CTC
ttttcctatatccttttaca

SEQ ID NO: 10250 - DNA, 20 bp, Artificial Sequence
  Description of Artificial Sequence: Synthetic oligonucleotide
  Target: ANGPTL3; (-) strand; PAM type: YTN; PAM sequence: TTC
ctcttttcctatatcctttt

SEQ ID NO: 10251 - DNA, 20 bp, Artificial Sequence
  Description of Artificial Sequence: Synthetic oligonucleotide
  Target: ANGPTL3; (-) strand; PAM type: YTN; PAM sequence: CTG
ccaggagtatatgagagttc

SEQ ID NO: 10252 - DNA, 20 bp, Artificial Sequence
  Description of Artificial Sequence: Synthetic oligonucleotide
  Target: ANGPTL3; (-) strand; PAM type: YTN; PAM sequence: TTA
catccctgccaggagtatat

SEQ ID NO: 10253 - DNA, 20 bp, Artificial Sequence
  Description of Artificial Sequence: Synthetic oligonucleotide
  Target: ANGPTL3; (-) strand; PAM type: YTN; PAM sequence: TTT
acatccctgccaggagtata

SEQ ID NO: 10254 - DNA, 20 bp, Artificial Sequence
  Description of Artificial Sequence: Synthetic oligonucleotide
  Target: ANGPTL3; (-) strand; PAM type: YTN; PAM sequence: TTG
taccaatttacatccctgcc

SEQ ID NO: 10255 - DNA, 20 bp, Artificial Sequence
  Description of Artificial Sequence: Synthetic oligonucleotide
  Target: ANGPTL3; (-) strand; PAM type: YTN; PAM sequence: TTC
aaaagggttgtaccaattta

SEQ ID NO: 10256 - DNA, 20 bp, Artificial Sequence
  Description of Artificial Sequence: Synthetic oligonucleotide
  Target: ANGPTL3; (-) strand; PAM type: YTN; PAM sequence: CTT
caaaagggttgtaccaattt

SEQ ID NO: 10257 - DNA, 20 bp, Artificial Sequence
  Description of Artificial Sequence: Synthetic oligonucleotide
  Target: ANGPTL3; (-) strand; PAM type: YTN; PAM sequence: TTG
tccttcaaaagggttgtacc

SEQ ID NO: 10258 - DNA, 20 bp, Artificial Sequence
  Description of Artificial Sequence: Synthetic oligonucleotide
  Target: ANGPTL3; (-) strand; PAM type: YTN; PAM sequence: TTG
tcagattgtccttcaaaagg

SEQ ID NO: 10259 - DNA, 20 bp, Artificial Sequence
  Description of Artificial Sequence: Synthetic oligonucleotide
  Target: ANGPTL3; (-) strand; PAM type: YTN; PAM sequence: TTT
gtcagattgtccttcaaaag

SEQ ID NO: 10260 - DNA, 20 bp, Artificial Sequence
  Description of Artificial Sequence: Synthetic oligonucleotide
  Target: ANGPTL3; (-) strand; PAM type: YTN; PAM sequence: TTT
tgtcagattgtccttcaaaa

SEQ ID NO: 10261 - DNA, 20 bp, Artificial Sequence
  Description of Artificial Sequence: Synthetic oligonucleotide
  Target: ANGPTL3; (-) strand; PAM type: YTN; PAM sequence: CTT
ttgtcagattgtccttcaaa

SEQ ID NO: 10262 - DNA, 20 bp, Artificial Sequence
  Description of Artificial Sequence: Synthetic oligonucleotide
  Target: ANGPTL3; (-) strand; PAM type: YTN; PAM sequence: TTG
cttttgtcagattgtccttc

SEQ ID NO: 10263 - DNA, 20 bp, Artificial Sequence
  Description of Artificial Sequence: Synthetic oligonucleotide
  Target: ANGPTL3; (-) strand; PAM type: YTN; PAM sequence: TTA
cgattgcttttgtcagattg

SEQ ID NO: 10264 - DNA, 20 bp, Artificial Sequence
  Description of Artificial Sequence: Synthetic oligonucleotide
  Target: ANGPTL3; (-) strand; PAM type: YTN; PAM sequence: CTT
acgattgcttttgtcagatt

SEQ ID NO: 10265 - DNA, 20 bp, Artificial Sequence
  Description of Artificial Sequence: Synthetic oligonucleotide
  Target: ANGPTL3; (-) strand; PAM type: YTN; PAM sequence: TTG
taacttacgattgcttttgt

SEQ ID NO: 10266 - DNA, 20 bp, Artificial Sequence
  Description of Artificial Sequence: Synthetic oligonucleotide
  Target: ANGPTL3; (-) strand; PAM type: YTN; PAM sequence: CTT
gtaacttacgattgcttttg

SEQ ID NO: 10267 - DNA, 20 bp, Artificial Sequence
  Description of Artificial Sequence: Synthetic oligonucleotide
  Target: ANGPTL3; (-) strand; PAM type: YTN; PAM sequence: TTG
acttgtaacttacgattgct

SEQ ID NO: 10268 - DNA, 20 bp, Artificial Sequence
  Description of Artificial Sequence: Synthetic oligonucleotide
  Target: ANGPTL3; (-) strand; PAM type: YTN; PAM sequence: TTC
atagatgttgacttgtaact

SEQ ID NO: 10269 - DNA, 20 bp, Artificial Sequence
  Description of Artificial Sequence: Synthetic oligonucleotide
  Target: ANGPTL3; (-) strand; PAM type: YTN; PAM sequence: TTC
atatacattcatagatgttg

SEQ ID NO: 10270 - DNA, 20 bp, Artificial Sequence
  Description of Artificial Sequence: Synthetic oligonucleotide
  Target: ANGPTL3; (-) strand; PAM type: YTN; PAM sequence: TTT
catatacattcatagatgtt

SEQ ID NO: 10271 - DNA, 20 bp, Artificial Sequence
  Description of Artificial Sequence: Synthetic oligonucleotide
  Target: ANGPTL3; (-) strand; PAM type: YTN; PAM sequence: TTT
tcatatacattcatagatgt

SEQ ID NO: 10272 - DNA, 20 bp, Artificial Sequence
  Description of Artificial Sequence: Synthetic oligonucleotide
  Target: ANGPTL3; (-) strand; PAM type: YTN; PAM sequence: TTA
tggtggtgatgtatgtatat

SEQ ID NO: 10273 - DNA, 20 bp, Artificial Sequence
  Description of Artificial Sequence: Synthetic oligonucleotide
  Target: ANGPTL3; (-) strand; PAM type: YTN; PAM sequence: TTT
atggtggtgatgtatgtata

SEQ ID NO: 10274 - DNA, 20 bp, Artificial Sequence
  Description of Artificial Sequence: Synthetic oligonucleotide
  Target: ANGPTL3; (-) strand; PAM type: YTN; PAM sequence: TTT
tatggtggtgatgtatgtat

SEQ ID NO: 10275 - DNA, 20 bp, Artificial Sequence
  Description of Artificial Sequence: Synthetic oligonucleotide
  Target: ANGPTL3; (-) strand; PAM type: YTN; PAM sequence: CTT
ttatggtggtgatgtatgta

SEQ ID NO: 10276 - DNA, 20 bp, Artificial Sequence
  Description of Artificial Sequence: Synthetic oligonucleotide
  Target: ANGPTL3; (-) strand; PAM type: YTN; PAM sequence: TTA
taaacagtatgtatagaaaa

SEQ ID NO: 10277 - DNA, 20 bp, Artificial Sequence
  Description of Artificial Sequence: Synthetic oligonucleotide
  Target: ANGPTL3; (-) strand; PAM type: YTN; PAM sequence: CTA
attataaacagtatgtatag

SEQ ID NO: 10278 - DNA, 20 bp, Artificial Sequence
  Description of Artificial Sequence: Synthetic oligonucleotide
  Target: ANGPTL3; (-) strand; PAM type: YTN; PAM sequence: TTC
taattataaacagtatgtat

SEQ ID NO: 10279 - DNA, 20 bp, Artificial Sequence
  Description of Artificial Sequence: Synthetic oligonucleotide
  Target: ANGPTL3; (-) strand; PAM type: YTN; PAM sequence: TTT
ctaattataaacagtatgta

SEQ ID NO: 10280 - DNA, 20 bp, Artificial Sequence
  Description of Artificial Sequence: Synthetic oligonucleotide
  Target: ANGPTL3; (-) strand; PAM type: YTN; PAM sequence: TTT
tctaattataaacagtatgt

SEQ ID NO: 10281 - DNA, 20 bp, Artificial Sequence
  Description of Artificial Sequence: Synthetic oligonucleotide
  Target: ANGPTL3; (-) strand; PAM type: YTN; PAM sequence: TTC
caattttctaattataaaca

SEQ ID NO: 10282 - DNA, 20 bp, Artificial Sequence
  Description of Artificial Sequence: Synthetic oligonucleotide
  Target: ANGPTL3; (-) strand; PAM type: YTN; PAM sequence: TTT
ccaattttctaattataaac

SEQ ID NO: 10283 - DNA, 20 bp, Artificial Sequence
  Description of Artificial Sequence: Synthetic oligonucleotide
  Target: ANGPTL3; (-) strand; PAM type: YTN; PAM sequence: TTG
tttccaattttctaattata

SEQ ID NO: 10284 - DNA, 20 bp, Artificial Sequence
  Description of Artificial Sequence: Synthetic oligonucleotide
  Target: ANGPTL3; (-) strand; PAM type: YTN; PAM sequence: TTT
gtttccaattttctaattat

SEQ ID NO: 10285 - DNA, 20 bp, Artificial Sequence
  Description of Artificial Sequence: Synthetic oligonucleotide
  Target: ANGPTL3; (-) strand; PAM type: YTN; PAM sequence: TTA
atcatttgtttccaattttc

SEQ ID NO: 10286 - DNA, 20 bp, Artificial Sequence
  Description of Artificial Sequence: Synthetic oligonucleotide
  Target: ANGPTL3; (-) strand; PAM type: YTN; PAM sequence: TTT
aatcatttgtttccaatttt

SEQ ID NO: 10287 - DNA, 20 bp, Artificial Sequence
  Description of Artificial Sequence: Synthetic oligonucleotide
  Target: ANGPTL3; (-) strand; PAM type: YTN; PAM sequence: TTT
taatcatttgtttccaattt

SEQ ID NO: 10288 - DNA, 20 bp, Artificial Sequence
  Description of Artificial Sequence: Synthetic oligonucleotide
  Target: ANGPTL3; (-) strand; PAM type: YTN; PAM sequence: CTT
ttaatcatttgtttccaatt

SEQ ID NO: 10289 - DNA, 20 bp, Artificial Sequence
  Description of Artificial Sequence: Synthetic oligonucleotide
  Target: ANGPTL3; (-) strand; PAM type: YTN; PAM sequence: TTA
atcagcccccttttaatcat

SEQ ID NO: 10290 - DNA, 20 bp, Artificial Sequence
  Description of Artificial Sequence: Synthetic oligonucleotide
  Target: ANGPTL3; (-) strand; PAM type: YTN; PAM sequence: TTT
aatcagcccccttttaatca

SEQ ID NO: 10291 - DNA, 20 bp, Artificial Sequence
  Description of Artificial Sequence: Synthetic oligonucleotide
  Target: ANGPTL3; (-) strand; PAM type: YTN; PAM sequence: TTA
atttaatcagccccctttta

SEQ ID NO: 10292 - DNA, 20 bp, Artificial Sequence
  Description of Artificial Sequence: Synthetic oligonucleotide
  Target: ANGPTL3; (-) strand; PAM type: YTN; PAM sequence: CTT
aatttaatcagccccctttt

SEQ ID NO: 10293 - DNA, 20 bp, Artificial Sequence
  Description of Artificial Sequence: Synthetic oligonucleotide
  Target: ANGPTL3; (-) strand; PAM type: YTN; PAM sequence: TTA
tatagatgaaccttaattta

SEQ ID NO: 10294 - DNA, 20 bp, Artificial Sequence
  Description of Artificial Sequence: Synthetic oligonucleotide
  Target: ANGPTL3; (-) strand; PAM type: YTN; PAM sequence: CTG
ttatatagatgaaccttaat

SEQ ID NO: 10295 - DNA, 20 bp, Artificial Sequence
  Description of Artificial Sequence: Synthetic oligonucleotide
  Target: ANGPTL3; (-) strand; PAM type: YTN; PAM sequence: CTG
cataatcctgttatatagat

SEQ ID NO: 10296 - DNA, 20 bp, Artificial Sequence
  Description of Artificial Sequence: Synthetic oligonucleotide
  Target: ANGPTL3; (-) strand; PAM type: YTN; PAM sequence: TTA
atagctgcataatcctgtta

SEQ ID NO: 10297 - DNA, 20 bp, Artificial Sequence
  Description of Artificial Sequence: Synthetic oligonucleotide
  Target: ANGPTL3; (-) strand; PAM type: YTN; PAM sequence: TTT
aatagctgcataatcctgtt

SEQ ID NO: 10298 - DNA, 20 bp, Artificial Sequence
  Description of Artificial Sequence: Synthetic oligonucleotide
  Target: ANGPTL3; (-) strand; PAM type: YTN; PAM sequence: TTT
taatagctgcataatcctgt

SEQ ID NO: 10299 - DNA, 20 bp, Artificial Sequence
  Description of Artificial Sequence: Synthetic oligonucleotide
  Target: ANGPTL3; (-) strand; PAM type: YTN; PAM sequence: TTT
ttaatagctgcataatcctg

SEQ ID NO: 10300 - DNA, 20 bp, Artificial Sequence
  Description of Artificial Sequence: Synthetic oligonucleotide
  Target: ANGPTL3; (-) strand; PAM type: YTN; PAM sequence: CTT
tttaatagctgcataatcct

SEQ ID NO: 10301 - DNA, 20 bp, Artificial Sequence
  Description of Artificial Sequence: Synthetic oligonucleotide
  Target: ANGPTL3; (-) strand; PAM type: YTN; PAM sequence: TTA
ccacgtcctttttaatagct

SEQ ID NO: 10302 - DNA, 20 bp, Artificial Sequence
  Description of Artificial Sequence: Synthetic oligonucleotide
  Target: ANGPTL3; (-) strand; PAM type: YTN; PAM sequence: CTA
tagagttaccacgtcctttt

SEQ ID NO: 10303 - DNA, 20 bp, Artificial Sequence
  Description of Artificial Sequence: Synthetic oligonucleotide
  Target: ANGPTL3; (-) strand; PAM type: YTN; PAM sequence: CTA
tgaatgtctatagagttacc

SEQ ID NO: 10304 - DNA, 20 bp, Artificial Sequence
  Description of Artificial Sequence: Synthetic oligonucleotide
  Target: ANGPTL3; (-) strand; PAM type: YTN; PAM sequence: TTC
ctatgaatgtctatagagtt

SEQ ID NO: 10305 - DNA, 20 bp, Artificial Sequence
  Description of Artificial Sequence: Synthetic oligonucleotide
  Target: ANGPTL3; (-) strand; PAM type: YTN; PAM sequence: TTT
cctatgaatgtctatagagt

SEQ ID NO: 10306 - DNA, 20 bp, Artificial Sequence
  Description of Artificial Sequence: Synthetic oligonucleotide
  Target: ANGPTL3; (-) strand; PAM type: YTN; PAM sequence: TTT
tcctatgaatgtctatagag

SEQ ID NO: 10307 - DNA, 20 bp, Artificial Sequence
  Description of Artificial Sequence: Synthetic oligonucleotide
  Target: ANGPTL3; (-) strand; PAM type: YTN; PAM sequence: TTA
ttttcctatgaatgtctata

SEQ ID NO: 10308 - DNA, 20 bp, Artificial Sequence
  Description of Artificial Sequence: Synthetic oligonucleotide
  Target: ANGPTL3; (-) strand; PAM type: YTN; PAM sequence: TTT
attttcctatgaatgtctat

SEQ ID NO: 10309 - DNA, 20 bp, Artificial Sequence
  Description of Artificial Sequence: Synthetic oligonucleotide
  Target: ANGPTL3; (-) strand; PAM type: YTN; PAM sequence: TTA
aaatttattttcctatgaat

SEQ ID NO: 10310 - DNA, 20 bp, Artificial Sequence
  Description of Artificial Sequence: Synthetic oligonucleotide
  Target: ANGPTL3; (-) strand; PAM type: YTN; PAM sequence: TTT
aaaatttattttcctatgaa

SEQ ID NO: 10311 - DNA, 20 bp, Artificial Sequence
  Description of Artificial Sequence: Synthetic oligonucleotide
  Target: ANGPTL3; (-) strand; PAM type: YTN; PAM sequence: TTT
taaaatttattttcctatga

SEQ ID NO: 10312 - DNA, 20 bp, Artificial Sequence
  Description of Artificial Sequence: Synthetic oligonucleotide
  Target: ANGPTL3; (-) strand; PAM type: YTN; PAM sequence: TTA
gtattttaaaatttattttc

SEQ ID NO: 10313 - DNA, 20 bp, Artificial Sequence
  Description of Artificial Sequence: Synthetic oligonucleotide
  Target: ANGPTL3; (-) strand; PAM type: YTN; PAM sequence: CTT
agtattttaaaatttatttt

SEQ ID NO: 10314 - DNA, 20 bp, Artificial Sequence
  Description of Artificial Sequence: Synthetic oligonucleotide
  Target: ANGPTL3; (-) strand; PAM type: YTN; PAM sequence: TTC
aggatcttagtattttaaaa

SEQ ID NO: 10315 - DNA, 20 bp, Artificial Sequence
  Description of Artificial Sequence: Synthetic oligonucleotide
  Target: ANGPTL3; (-) strand; PAM type: YTN; PAM sequence: CTC
atgatatatatatcattcag

SEQ ID NO: 10316 - DNA, 20 bp, Artificial Sequence
  Description of Artificial Sequence: Synthetic oligonucleotide
  Target: ANGPTL3; (-) strand; PAM type: YTN; PAM sequence: TTA
tgtataatagctcatgatat

SEQ ID NO: 10317 - DNA, 20 bp, Artificial Sequence
  Description of Artificial Sequence: Synthetic oligonucleotide
  Target: ANGPTL3; (-) strand; PAM type: YTN; PAM sequence: TTG
ttatgtataatagctcatga

SEQ ID NO: 10318 - DNA, 20 bp, Artificial Sequence
  Description of Artificial Sequence: Synthetic oligonucleotide
  Target: ANGPTL3; (-) strand; PAM type: YTN; PAM sequence: CTT
gttatgtataatagctcatg

SEQ ID NO: 10319 - DNA, 20 bp, Artificial Sequence
  Description of Artificial Sequence: Synthetic oligonucleotide
  Target: ANGPTL3; (-) strand; PAM type: YTN; PAM sequence: TTA
taacacaagtgggatcttgt

SEQ ID NO: 10320 - DNA, 20 bp, Artificial Sequence
  Description of Artificial Sequence: Synthetic oligonucleotide
  Target: ANGPTL3; (-) strand; PAM type: YTN; PAM sequence: TTT
ataacacaagtgggatcttg

SEQ ID NO: 10321 - DNA, 20 bp, Artificial Sequence
  Description of Artificial Sequence: Synthetic oligonucleotide
  Target: ANGPTL3; (-) strand; PAM type: YTN; PAM sequence: TTT
tataacacaagtgggatctt

SEQ ID NO: 10322 - DNA, 20 bp, Artificial Sequence
  Description of Artificial Sequence: Synthetic oligonucleotide
  Target: ANGPTL3; (-) strand; PAM type: YTN; PAM sequence: TTT
ttataacacaagtgggatct

SEQ ID NO: 10323 - DNA, 20 bp, Artificial Sequence
  Description of Artificial Sequence: Synthetic oligonucleotide
  Target: ANGPTL3; (-) strand; PAM type: YTN; PAM sequence: TTT
tttataacacaagtgggatc

SEQ ID NO: 10324 - DNA, 20 bp, Artificial Sequence
  Description of Artificial Sequence: Synthetic oligonucleotide
  Target: ANGPTL3; (-) strand; PAM type: YTN; PAM sequence: CTA
aacataattttttataacac

SEQ ID NO: 10325 - DNA, 20 bp, Artificial Sequence
  Description of Artificial Sequence: Synthetic oligonucleotide
  Target: ANGPTL3; (-) strand; PAM type: YTN; PAM sequence: TTG
aatgactaaacataattttt

SEQ ID NO: 10326 - DNA, 20 bp, Artificial Sequence
  Description of Artificial Sequence: Synthetic oligonucleotide
  Target: ANGPTL3; (-) strand; PAM type: YTN; PAM sequence: TTT
gaatgactaaacataatttt

SEQ ID NO: 10327 - DNA, 20 bp, Artificial Sequence
  Description of Artificial Sequence: Synthetic oligonucleotide
  Target: ANGPTL3; (-) strand; PAM type: YTN; PAM sequence: CTT
tgaatgactaaacataattt

SEQ ID NO: 10328 - DNA, 20 bp, Artificial Sequence
  Description of Artificial Sequence: Synthetic oligonucleotide
  Target: ANGPTL3; (-) strand; PAM type: YTN; PAM sequence: CTA
tcataccagaccctttgaat

SEQ ID NO: 10329 - DNA, 20 bp, Artificial Sequence
  Description of Artificial Sequence: Synthetic oligonucleotide
  Target: ANGPTL3; (-) strand; PAM type: YTN; PAM sequence: TTG
ggtctatcataccagaccct

SEQ ID NO: 10330 - DNA, 20 bp, Artificial Sequence
  Description of Artificial Sequence: Synthetic oligonucleotide
  Target: ANGPTL3; (-) strand; PAM type: YTN; PAM sequence: TTT
gggtctatcataccagaccc

SEQ ID NO: 10331 - DNA, 20 bp, Artificial Sequence
  Description of Artificial Sequence: Synthetic oligonucleotide
  Target: ANGPTL3; (-) strand; PAM type: YTN; PAM sequence: TTT
tgggtctatcataccagacc

SEQ ID NO: 10332 - DNA, 20 bp, Artificial Sequence
  Description of Artificial Sequence: Synthetic oligonucleotide
  Target: ANGPTL3; (-) strand; PAM type: YTN; PAM sequence: TTA
acattttgggtctatcatac

SEQ ID NO: 10333 - DNA, 20 bp, Artificial Sequence
  Description of Artificial Sequence: Synthetic oligonucleotide
  Target: ANGPTL3; (-) strand; PAM type: YTN; PAM sequence: CTA
ttaacattttgggtctatca

SEQ ID NO: 10334 - DNA, 20 bp, Artificial Sequence
  Description of Artificial Sequence: Synthetic oligonucleotide
  Target: ANGPTL3; (-) strand; PAM type: YTN; PAM sequence: CTC
tattaacattttgggtctat

SEQ ID NO: 10335 - DNA, 20 bp, Artificial Sequence
  Description of Artificial Sequence: Synthetic oligonucleotide
  Target: ANGPTL3; (-) strand; PAM type: YTN; PAM sequence: CTC
gactctattaacattttggg

SEQ ID NO: 10336 - DNA, 20 bp, Artificial Sequence
  Description of Artificial Sequence: Synthetic oligonucleotide
  Target: ANGPTL3; (-) strand; PAM type: YTN; PAM sequence: CTA
taaaaaataaaaatctcgac

SEQ ID NO: 10337 - DNA, 20 bp, Artificial Sequence
  Description of Artificial Sequence: Synthetic oligonucleotide
  Target: ANGPTL3; (-) strand; PAM type: YTN; PAM sequence: TTC
aaaaacctataaaaaataaa

SEQ ID NO: 10338 - DNA, 20 bp, Artificial Sequence
  Description of Artificial Sequence: Synthetic oligonucleotide
  Target: ANGPTL3; (-) strand; PAM type: YTN; PAM sequence: TTT
caaaaacctataaaaaataa

SEQ ID NO: 10339 - DNA, 20 bp, Artificial Sequence
  Description of Artificial Sequence: Synthetic oligonucleotide
  Target: ANGPTL3; (-) strand; PAM type: YTN; PAM sequence: TTC
aggtatttcaaaaacctata

SEQ ID NO: 10340 - DNA, 20 bp, Artificial Sequence
  Description of Artificial Sequence: Synthetic oligonucleotide
  Target: ANGPTL3; (-) strand; PAM type: YTN; PAM sequence: TTG
tgaaaattcaggtatttcaa

SEQ ID NO: 10341 - DNA, 20 bp, Artificial Sequence
  Description of Artificial Sequence: Synthetic oligonucleotide
  Target: ANGPTL3; (-) strand; PAM type: YTN; PAM sequence: TTA
ttgtgaaaattcaggtattt

SEQ ID NO: 10342 - DNA, 20 bp, Artificial Sequence
  Description of Artificial Sequence: Synthetic oligonucleotide
  Target: ANGPTL3; (-) strand; PAM type: YTN; PAM sequence: CTT
attgtgaaaattcaggtatt

SEQ ID NO: 10343 - DNA, 20 bp, Artificial Sequence
  Description of Artificial Sequence: Synthetic oligonucleotide
  Target: ANGPTL3; (-) strand; PAM type: YTN; PAM sequence: TTA
atgtgcaaagtacttattgt

SEQ ID NO: 10344 - DNA, 20 bp, Artificial Sequence
  Description of Artificial Sequence: Synthetic oligonucleotide
  Target: ANGPTL3; (-) strand; PAM type: YTN; PAM sequence: TTT
aatgtgcaaagtacttattg

SEQ ID NO: 10345 - DNA, 20 bp, Artificial Sequence
  Description of Artificial Sequence: Synthetic oligonucleotide
  Target: ANGPTL3; (-) strand; PAM type: YTN; PAM sequence: TTT
taatgtgcaaagtacttatt

SEQ ID NO: 10346 - DNA, 20 bp, Artificial Sequence
  Description of Artificial Sequence: Synthetic oligonucleotide
  Target: ANGPTL3; (-) strand; PAM type: YTN; PAM sequence: TTT
ttaatgtgcaaagtacttat

SEQ ID NO: 10347 - DNA, 20 bp, Artificial Sequence
  Description of Artificial Sequence: Synthetic oligonucleotide
  Target: ANGPTL3; (-) strand; PAM type: YTN; PAM sequence: CTA
agatttttaatgtgcaaagt

SEQ ID NO: 10348 - DNA, 20 bp, Artificial Sequence
  Description of Artificial Sequence: Synthetic oligonucleotide
  Target: ANGPTL3; (-) strand; PAM type: YTN; PAM sequence: TTA
caagcgtgagccaccatgcc

SEQ ID NO: 10349 - DNA, 20 bp, Artificial Sequence
  Description of Artificial Sequence: Synthetic oligonucleotide
  Target: ANGPTL3; (-) strand; PAM type: YTN; PAM sequence: CTG
ggattacaagcgtgagccac

SEQ ID NO: 10350 - DNA, 20 bp, Artificial Sequence
  Description of Artificial Sequence: Synthetic oligonucleotide
  Target: ANGPTL3; (-) strand; PAM type: YTN; PAM sequence: CTC
ccagagtgctgggattacaa

SEQ ID NO: 10351 - DNA, 20 bp, Artificial Sequence
  Description of Artificial Sequence: Synthetic oligonucleotide
  Target: ANGPTL3; (-) strand; PAM type: YTN; PAM sequence: TTG
gcctcccagagtgctgggat

SEQ ID NO: 10352 - DNA, 20 bp, Artificial Sequence
  Description of Artificial Sequence: Synthetic oligonucleotide
  Target: ANGPTL3; (-) strand; PAM type: YTN; PAM sequence: CTT
ggcctcccagagtgctggga

SEQ ID NO: 10353 - DNA, 20 bp, Artificial Sequence
  Description of Artificial Sequence: Synthetic oligonucleotide
  Target: ANGPTL3; (-) strand; PAM type: YTN; PAM sequence: CTA
ccttggcctcccagagtgct

SEQ ID NO: 10354 - DNA, 20 bp, Artificial Sequence
  Description of Artificial Sequence: Synthetic oligonucleotide
  Target: ANGPTL3; (-) strand; PAM type: YTN; PAM sequence: CTG
cctaccttggcctcccagag

SEQ ID NO: 10355 - DNA, 20 bp, Artificial Sequence
  Description of Artificial Sequence: Synthetic oligonucleotide
  Target: ANGPTL3; (-) strand; PAM type: YTN; PAM sequence: CTC
aggtgatctgcctaccttgg

SEQ ID NO: 10356 - DNA, 20 bp, Artificial Sequence
  Description of Artificial Sequence: Synthetic oligonucleotide
  Target: ANGPTL3; (-) strand; PAM type: YTN; PAM sequence: CTG
acctcaggtgatctgcctac

SEQ ID NO: 10357 - DNA, 20 bp, Artificial Sequence
  Description of Artificial Sequence: Synthetic oligonucleotide
  Target: ANGPTL3; (-) strand; PAM type: YTN; PAM sequence: CTC
ctgacctcaggtgatctgcc

SEQ ID NO: 10358 - DNA, 20 bp, Artificial Sequence
  Description of Artificial Sequence: Synthetic oligonucleotide
  Target: ANGPTL3; (-) strand; PAM type: YTN; PAM sequence: CTC
gaactcctgacctcaggtga

SEQ ID NO: 10359 - DNA, 20 bp, Artificial Sequence
  Description of Artificial Sequence: Synthetic oligonucleotide
  Target: ANGPTL3; (-) strand; PAM type: YTN; PAM sequence: CTG
gtctcgaactcctgacctca

SEQ ID NO: 10360 - DNA, 20 bp, Artificial Sequence
  Description of Artificial Sequence: Synthetic oligonucleotide
  Target: ANGPTL3; (-) strand; PAM type: YTN; PAM sequence: TTG
gccagactggtctcgaactc

SEQ ID NO: 10361 - DNA, 20 bp, Artificial Sequence
  Description of Artificial Sequence: Synthetic oligonucleotide
  Target: ANGPTL3; (-) strand; PAM type: YTN; PAM sequence: TTC
accatgttggccagactggt

SEQ ID NO: 10362 - DNA, 20 bp, Artificial Sequence
  Description of Artificial Sequence: Synthetic oligonucleotide
  Target: ANGPTL3; (-) strand; PAM type: YTN; PAM sequence: TTT
caccatgttggccagactgg

SEQ ID NO: 10363 - DNA, 20 bp, Artificial Sequence
  Description of Artificial Sequence: Synthetic oligonucleotide
  Target: ANGPTL3; (-) strand; PAM type: YTN; PAM sequence: TTA
gtagagacggggtttcacca

SEQ ID NO: 10364 - DNA, 20 bp, Artificial Sequence
  Description of Artificial Sequence: Synthetic oligonucleotide
  Target: ANGPTL3; (-) strand; PAM type: YTN; PAM sequence: TTT
agtagagacggggtttcacc

SEQ ID NO: 10365 - DNA, 20 bp, Artificial Sequence
  Description of Artificial Sequence: Synthetic oligonucleotide
  Target: ANGPTL3; (-) strand; PAM type: YTN; PAM sequence: TTT
tagtagagacggggtttcac

SEQ ID NO: 10366 - DNA, 20 bp, Artificial Sequence
  Description of Artificial Sequence: Synthetic oligonucleotide
  Target: ANGPTL3; (-) strand; PAM type: YTN; PAM sequence: TTT
ttagtagagacggggtttca

SEQ ID NO: 10367 - DNA, 20 bp, Artificial Sequence
  Description of Artificial Sequence: Synthetic oligonucleotide
  Target: ANGPTL3; (-) strand; PAM type: YTN; PAM sequence: TTG
tatttttagtagagacgggg

SEQ ID NO: 10368 - DNA, 20 bp, Artificial Sequence
  Description of Artificial Sequence: Synthetic oligonucleotide
  Target: ANGPTL3; (-) strand; PAM type: YTN; PAM sequence: TTT
gtatttttagtagagacggg

SEQ ID NO: 10369 - DNA, 20 bp, Artificial Sequence
  Description of Artificial Sequence: Synthetic oligonucleotide
  Target: ANGPTL3; (-) strand; PAM type: YTN; PAM sequence: TTT
tgtatttttagtagagacgg

SEQ ID NO: 10370 - DNA, 20 bp, Artificial Sequence
  Description of Artificial Sequence: Synthetic oligonucleotide
  Target: ANGPTL3; (-) strand; PAM type: YTN; PAM sequence: TTT
ttgtatttttagtagagacg

SEQ ID NO: 10371 - DNA, 20 bp, Artificial Sequence
  Description of Artificial Sequence: Synthetic oligonucleotide
  Target: ANGPTL3; (-) strand; PAM type: YTN; PAM sequence: CTA
atttttgtatttttagtaga

SEQ ID NO: 10372 - DNA, 20 bp, Artificial Sequence
  Description of Artificial Sequence: Synthetic oligonucleotide
  Target: ANGPTL3; (-) strand; PAM type: YTN; PAM sequence: CTG
gctaatttttgtatttttag

SEQ ID NO: 10373 - DNA, 20 bp, Artificial Sequence
  Description of Artificial Sequence: Synthetic oligonucleotide
  Target: ANGPTL3; (-) strand; PAM type: YTN; PAM sequence: TTA
caggcacccccaaccaagcc

SEQ ID NO: 10374 - DNA, 20 bp, Artificial Sequence
  Description of Artificial Sequence: Synthetic oligonucleotide
  Target: ANGPTL3; (-) strand; PAM type: YTN; PAM sequence: CTG
gaattacaggcacccccaac

SEQ ID NO: 10375 - DNA, 20 bp, Artificial Sequence
  Description of Artificial Sequence: Synthetic oligonucleotide
  Target: ANGPTL3; (-) strand; PAM type: YTN; PAM sequence: TTC
ccgagtatctggaattacag

SEQ ID NO: 10376 - DNA, 20 bp, Artificial Sequence
  Description of Artificial Sequence: Synthetic oligonucleotide
  Target: ANGPTL3; (-) strand; PAM type: YTN; PAM sequence: CTT
cccgagtatctggaattaca

SEQ ID NO: 10377 - DNA, 20 bp, Artificial Sequence
  Description of Artificial Sequence: Synthetic oligonucleotide
  Target: ANGPTL3; (-) strand; PAM type: YTN; PAM sequence: CTC
agcttcccgagtatctggaa

SEQ ID NO: 10378 - DNA, 20 bp, Artificial Sequence
  Description of Artificial Sequence: Synthetic oligonucleotide
  Target: ANGPTL3; (-) strand; PAM type: YTN; PAM sequence: CTG
tctcagcttcccgagtatct

SEQ ID NO: 10379 - DNA, 20 bp, Artificial Sequence
  Description of Artificial Sequence: Synthetic oligonucleotide
  Target: ANGPTL3; (-) strand; PAM type: YTN; PAM sequence: CTC
ctgtctcagcttcccgagta

SEQ ID NO: 10380 - DNA, 20 bp, Artificial Sequence
  Description of Artificial Sequence: Synthetic oligonucleotide
  Target: ANGPTL3; (-) strand; PAM type: YTN; PAM sequence: TTC
tcctgtctcagcttcccgag

SEQ ID NO: 10381 - DNA, 20 bp, Artificial Sequence
  Description of Artificial Sequence: Synthetic oligonucleotide
  Target: ANGPTL3; (-) strand; PAM type: YTN; PAM sequence: TTC
aagcgattctcctgtctcag

SEQ ID NO: 10382 - DNA, 20 bp, Artificial Sequence
  Description of Artificial Sequence: Synthetic oligonucleotide
  Target: ANGPTL3; (-) strand; PAM type: YTN; PAM sequence: CTG
ggttcaagcgattctcctgt

SEQ ID NO: 10383 - DNA, 20 bp, Artificial Sequence
  Description of Artificial Sequence: Synthetic oligonucleotide
  Target: ANGPTL3; (-) strand; PAM type: YTN; PAM sequence: CTC
ctgggttcaagcgattctcc

SEQ ID NO: 10384 - DNA, 20 bp, Artificial Sequence
  Description of Artificial Sequence: Synthetic oligonucleotide
  Target: ANGPTL3; (-) strand; PAM type: YTN; PAM sequence: TTC
cccctcctgggttcaagcga

SEQ ID NO: 10385 - DNA, 20 bp, Artificial Sequence
  Description of Artificial Sequence: Synthetic oligonucleotide
  Target: ANGPTL3; (-) strand; PAM type: YTN; PAM sequence: CTT
ccccctcctgggttcaagcg

SEQ ID NO: 10386 - DNA, 20 bp, Artificial Sequence
  Description of Artificial Sequence: Synthetic oligonucleotide
  Target: ANGPTL3; (-) strand; PAM type: YTN; PAM sequence: CTG
caacttccccctcctgggtt

SEQ ID NO: 10387 - DNA, 20 bp, Artificial Sequence
  Description of Artificial Sequence: Synthetic oligonucleotide
  Target: ANGPTL3; (-) strand; PAM type: YTN; PAM sequence: CTC
actgcaacttccccctcctg

SEQ ID NO: 10388 - DNA, 20 bp, Artificial Sequence
  Description of Artificial Sequence: Synthetic oligonucleotide
  Target: ANGPTL3; (-) strand; PAM type: YTN; PAM sequence: CTC
agctcactgcaacttccccc

SEQ ID NO: 10389 - DNA, 20 bp, Artificial Sequence
  Description of Artificial Sequence: Synthetic oligonucleotide
  Target: ANGPTL3; (-) strand; PAM type: YTN; PAM sequence: CTG
gagtgcagcgtcgtgatctc

SEQ ID NO: 10390 - DNA, 20 bp, Artificial Sequence
  Description of Artificial Sequence: Synthetic oligonucleotide
  Target: ANGPTL3; (-) strand; PAM type: YTN; PAM sequence: TTG
cccaggctggagtgcagcgt

SEQ ID NO: 10391 - DNA, 20 bp, Artificial Sequence
  Description of Artificial Sequence: Synthetic oligonucleotide
  Target: ANGPTL3; (-) strand; PAM type: YTN; PAM sequence: TTG
ttgcccaggctggagtgcag

SEQ ID NO: 10392 - DNA, 20 bp, Artificial Sequence
  Description of Artificial Sequence: Synthetic oligonucleotide
  Target: ANGPTL3; (-) strand; PAM type: YTN; PAM sequence: TTT
gttgcccaggctggagtgca

SEQ ID NO: 10393 - DNA, 20 bp, Artificial Sequence
  Description of Artificial Sequence: Synthetic oligonucleotide
  Target: ANGPTL3; (-) strand; PAM type: YTN; PAM sequence: CTT
tgttgcccaggctggagtgc

SEQ ID NO: 10394 - DNA, 20 bp, Artificial Sequence
  Description of Artificial Sequence: Synthetic oligonucleotide
  Target: ANGPTL3; (-) strand; PAM type: YTN; PAM sequence: CTC
tttgttgcccaggctggagt

SEQ ID NO: 10395 - DNA, 20 bp, Artificial Sequence
  Description of Artificial Sequence: Synthetic oligonucleotide
  Target: ANGPTL3; (-) strand; PAM type: YTN; PAM sequence: TTG
ctctttgttgcccaggctgg

SEQ ID NO: 10396 - DNA, 20 bp, Artificial Sequence
  Description of Artificial Sequence: Synthetic oligonucleotide
  Target: ANGPTL3; (-) strand; PAM type: YTN; PAM sequence: TTT
gctctttgttgcccaggctg

SEQ ID NO: 10397 - DNA, 20 bp, Artificial Sequence
  Description of Artificial Sequence: Synthetic oligonucleotide
  Target: ANGPTL3; (-) strand; PAM type: YTN; PAM sequence: TTT
tgctctttgttgcccaggct

SEQ ID NO: 10398 - DNA, 20 bp, Artificial Sequence
  Description of Artificial Sequence: Synthetic oligonucleotide
  Target: ANGPTL3; (-) strand; PAM type: YTN; PAM sequence: TTG
agacggagttttgctctttg

SEQ ID NO: 10399 - DNA, 20 bp, Artificial Sequence
  Description of Artificial Sequence: Synthetic oligonucleotide
  Target: ANGPTL3; (-) strand; PAM type: YTN; PAM sequence: TTT
gagacggagttttgctcttt

SEQ ID NO: 10400 - DNA, 20 bp, Artificial Sequence
  Description of Artificial Sequence: Synthetic oligonucleotide
  Target: ANGPTL3; (-) strand; PAM type: YTN; PAM sequence: TTT
tgagacggagttttgctctt

SEQ ID NO: 10401 - DNA, 20 bp, Artificial Sequence
  Description of Artificial Sequence: Synthetic oligonucleotide
  Target: ANGPTL3; (-) strand; PAM type: YTN; PAM sequence: TTT
ttgagacggagttttgctct

SEQ ID NO: 10402 - DNA, 20 bp, Artificial Sequence
  Description of Artificial Sequence: Synthetic oligonucleotide
  Target: ANGPTL3; (-) strand; PAM type: YTN; PAM sequence: TTA
tttttgagacggagttttgc

SEQ ID NO: 10403 - DNA, 20 bp, Artificial Sequence
  Description of Artificial Sequence: Synthetic oligonucleotide
  Target: ANGPTL3; (-) strand; PAM type: YTN; PAM sequence: TTT
atttttgagacggagttttg

SEQ ID NO: 10404 - DNA, 20 bp, Artificial Sequence
  Description of Artificial Sequence: Synthetic oligonucleotide
  Target: ANGPTL3; (-) strand; PAM type: YTN; PAM sequence: TTA
tttatttttgagacggagtt

SEQ ID NO: 10405 - DNA, 20 bp, Artificial Sequence
  Description of Artificial Sequence: Synthetic oligonucleotide
  Target: ANGPTL3; (-) strand; PAM type: YTN; PAM sequence: TTT
atttatttttgagacggagt

SEQ ID NO: 10406 - DNA, 20 bp, Artificial Sequence
  Description of Artificial Sequence: Synthetic oligonucleotide
  Target: ANGPTL3; (-) strand; PAM type: YTN; PAM sequence: CTT
tatttatttttgagacggag

SEQ ID NO: 10407 - DNA, 20 bp, Artificial Sequence
  Description of Artificial Sequence: Synthetic oligonucleotide
  Target: ANGPTL3; (-) strand; PAM type: YTN; PAM sequence: TTC
tttatttatttttgagacgg

SEQ ID NO: 10408 - DNA, 20 bp, Artificial Sequence
  Description of Artificial Sequence: Synthetic oligonucleotide
  Target: ANGPTL3; (-) strand; PAM type: YTN; PAM sequence: TTT
ctttatttatttttgagacg

SEQ ID NO: 10409 - DNA, 20 bp, Artificial Sequence
  Description of Artificial Sequence: Synthetic oligonucleotide
  Target: ANGPTL3; (-) strand; PAM type: YTN; PAM sequence: TTT
tctttatttatttttgagac

SEQ ID NO: 10410 - DNA, 20 bp, Artificial Sequence
  Description of Artificial Sequence: Synthetic oligonucleotide
  Target: ANGPTL3; (-) strand; PAM type: YTN; PAM sequence: TTT
ttctttatttatttttgaga

SEQ ID NO: 10411 - DNA, 20 bp, Artificial Sequence
  Description of Artificial Sequence: Synthetic oligonucleotide
  Target: ANGPTL3; (-) strand; PAM type: YTN; PAM sequence: TTT
tttctttatttatttttgag

SEQ ID NO: 10412 - DNA, 20 bp, Artificial Sequence
  Description of Artificial Sequence: Synthetic oligonucleotide
  Target: ANGPTL3; (-) strand; PAM type: YTN; PAM sequence: TTG
gacatgtaaagattttttct

SEQ ID NO: 10413 - DNA, 20 bp, Artificial Sequence
  Description of Artificial Sequence: Synthetic oligonucleotide
  Target: ANGPTL3; (-) strand; PAM type: YTN; PAM sequence: TTT
ggacatgtaaagattttttc

SEQ ID NO: 10414 - DNA, 20 bp, Artificial Sequence
  Description of Artificial Sequence: Synthetic oligonucleotide
  Target: ANGPTL3; (-) strand; PAM type: YTN; PAM sequence: CTT
tggacatgtaaagatttttt

SEQ ID NO: 10415 - DNA, 20 bp, Artificial Sequence
  Description of Artificial Sequence: Synthetic oligonucleotide
  Target: ANGPTL3; (-) strand; PAM type: YTN; PAM sequence: TTG
aacagccgtatctttggaca

SEQ ID NO: 10416 - DNA, 20 bp, Artificial Sequence
  Description of Artificial Sequence: Synthetic oligonucleotide
  Target: ANGPTL3; (-) strand; PAM type: YTN; PAM sequence: TTA
gttgaacagccgtatctttg

SEQ ID NO: 10417 - DNA, 20 bp, Artificial Sequence
  Description of Artificial Sequence: Synthetic oligonucleotide
  Target: ANGPTL3; (-) strand; PAM type: YTN; PAM sequence: TTT
agttgaacagccgtatcttt

SEQ ID NO: 10418 - DNA, 20 bp, Artificial Sequence
  Description of Artificial Sequence: Synthetic oligonucleotide
  Target: ANGPTL3; (-) strand; PAM type: YTN; PAM sequence: TTT
tagttgaacagccgtatctt

SEQ ID NO: 10419 - DNA, 20 bp, Artificial Sequence
  Description of Artificial Sequence: Synthetic oligonucleotide
  Target: ANGPTL3; (-) strand; PAM type: YTN; PAM sequence: TTT
ttagttgaacagccgtatct

SEQ ID NO: 10420 - DNA, 20 bp, Artificial Sequence
  Description of Artificial Sequence: Synthetic oligonucleotide
  Target: ANGPTL3; (-) strand; PAM type: YTN; PAM sequence: TTT
tttagttgaacagccgtatc

SEQ ID NO: 10421 - DNA, 20 bp, Artificial Sequence
  Description of Artificial Sequence: Synthetic oligonucleotide
  Target: ANGPTL3; (-) strand; PAM type: YTN; PAM sequence: TTA
tacatatatattttttagtt

SEQ ID NO: 10422 - DNA, 20 bp, Artificial Sequence
  Description of Artificial Sequence: Synthetic oligonucleotide
  Target: ANGPTL3; (-) strand; PAM type: YTN; PAM sequence: TTT
atacatatatattttttagt

SEQ ID NO: 10423 - DNA, 20 bp, Artificial Sequence
  Description of Artificial Sequence: Synthetic oligonucleotide
  Target: ANGPTL3; (-) strand; PAM type: YTN; PAM sequence: TTT
tatacatatatattttttag

SEQ ID NO: 10424 - DNA, 20 bp, Artificial Sequence
  Description of Artificial Sequence: Synthetic oligonucleotide
  Target: ANGPTL3; (-) strand; PAM type: YTN; PAM sequence: TTA
agttttatacatatatattt

SEQ ID NO: 10425 - DNA, 20 bp, Artificial Sequence
  Description of Artificial Sequence: Synthetic oligonucleotide
  Target: ANGPTL3; (-) strand; PAM type: YTN; PAM sequence: TTA
acatgttaagttttatacat

SEQ ID NO: 10426 - DNA, 20 bp, Artificial Sequence
  Description of Artificial Sequence: Synthetic oligonucleotide
  Target: ANGPTL3; (-) strand; PAM type: YTN; PAM sequence: CTA
ttaacatgttaagttttata

SEQ ID NO: 10427 - DNA, 20 bp, Artificial Sequence
  Description of Artificial Sequence: Synthetic oligonucleotide
  Target: ANGPTL3; (-) strand; PAM type: YTN; PAM sequence: TTC
actattaacatgttaagttt

SEQ ID NO: 10428 - DNA, 20 bp, Artificial Sequence
  Description of Artificial Sequence: Synthetic oligonucleotide
  Target: ANGPTL3; (-) strand; PAM type: YTN; PAM sequence: TTG
tgtgttcactattaacatgt

SEQ ID NO: 10429 - DNA, 20 bp, Artificial Sequence
  Description of Artificial Sequence: Synthetic oligonucleotide
  Target: ANGPTL3; (-) strand; PAM type: YTN; PAM sequence: TTT
gtgtgttcactattaacatg

SEQ ID NO: 10430 - DNA, 20 bp, Artificial Sequence
  Description of Artificial Sequence: Synthetic oligonucleotide
  Target: ANGPTL3; (-) strand; PAM type: YTN; PAM sequence: TTT
tgtgtgttcactattaacat

SEQ ID NO: 10431 - DNA, 20 bp, Artificial Sequence
  Description of Artificial Sequence: Synthetic oligonucleotide
  Target: ANGPTL3; (-) strand; PAM type: YTN; PAM sequence: CTG
ttttgtgtgttcactattaa

SEQ ID NO: 10432 - DNA, 20 bp, Artificial Sequence
  Description of Artificial Sequence: Synthetic oligonucleotide
  Target: ANGPTL3; (-) strand; PAM type: YTN; PAM sequence: TTA
ctgttttgtgtgttcactat

SEQ ID NO: 10433 - DNA, 20 bp, Artificial Sequence
  Description of Artificial Sequence: Synthetic oligonucleotide
  Target: ANGPTL3; (-) strand; PAM type: YTN; PAM sequence: CTT
actgttttgtgtgttcacta

SEQ ID NO: 10434 - DNA, 20 bp, Artificial Sequence
  Description of Artificial Sequence: Synthetic oligonucleotide
  Target: ANGPTL3; (-) strand; PAM type: YTN; PAM sequence: CTA
tcttactgttttgtgtgttc

SEQ ID NO: 10435 - DNA, 20 bp, Artificial Sequence
  Description of Artificial Sequence: Synthetic oligonucleotide
  Target: ANGPTL3; (-) strand; PAM type: YTN; PAM sequence: TTA
tctatcttactgttttgtgt

SEQ ID NO: 10436 - DNA, 20 bp, Artificial Sequence
  Description of Artificial Sequence: Synthetic oligonucleotide
  Target: ANGPTL3; (-) strand; PAM type: YTN; PAM sequence: TTT
atctatcttactgttttgtg

SEQ ID NO: 10437 - DNA, 20 bp, Artificial Sequence
  Description of Artificial Sequence: Synthetic oligonucleotide
  Target: ANGPTL3; (-) strand; PAM type: YTN; PAM sequence: TTT
tatctatcttactgttttgt

SEQ ID NO: 10438 - DNA, 20 bp, Artificial Sequence
  Description of Artificial Sequence: Synthetic oligonucleotide
  Target: ANGPTL3; (-) strand; PAM type: YTN; PAM sequence: TTG
aaggaataattttatctatc

SEQ ID NO: 10439 - DNA, 20 bp, Artificial Sequence
  Description of Artificial Sequence: Synthetic oligonucleotide
  Target: ANGPTL3; (-) strand; PAM type: YTN; PAM sequence: TTT
gaaggaataattttatctat

SEQ ID NO: 10440 - DNA, 20 bp, Artificial Sequence
  Description of Artificial Sequence: Synthetic oligonucleotide
  Target: ANGPTL3; (-) strand; PAM type: YTN; PAM sequence: CTT
tgaaggaataattttatcta

SEQ ID NO: 10441 - DNA, 20 bp, Artificial Sequence
  Description of Artificial Sequence: Synthetic oligonucleotide
  Target: ANGPTL3; (-) strand; PAM type: YTN; PAM sequence: TTA
agtgagctttgaaggaataa

SEQ ID NO: 10442 - DNA, 20 bp, Artificial Sequence
  Description of Artificial Sequence: Synthetic oligonucleotide
  Target: ANGPTL3; (-) strand; PAM type: YTN; PAM sequence: TTG
gacagtgtagatccagaggt

SEQ ID NO: 10443 - DNA, 20 bp, Artificial Sequence
  Description of Artificial Sequence: Synthetic oligonucleotide
  Target: ANGPTL3; (-) strand; PAM type: YTN; PAM sequence: TTT
ggacagtgtagatccagagg

SEQ ID NO: 10444 - DNA, 20 bp, Artificial Sequence
  Description of Artificial Sequence: Synthetic oligonucleotide
  Target: ANGPTL3; (-) strand; PAM type: YTN; PAM sequence: TTT
tggacagtgtagatccagag

SEQ ID NO: 10445 - DNA, 20 bp, Artificial Sequence
  Description of Artificial Sequence: Synthetic oligonucleotide
  Target: ANGPTL3; (-) strand; PAM type: YTN; PAM sequence: TTT
ttggacagtgtagatccaga

SEQ ID NO: 10446 - DNA, 20 bp, Artificial Sequence
  Description of Artificial Sequence: Synthetic oligonucleotide
  Target: ANGPTL3; (-) strand; PAM type: YTN; PAM sequence: CTT
tttggacagtgtagatccag

SEQ ID NO: 10447 - DNA, 20 bp, Artificial Sequence
  Description of Artificial Sequence: Synthetic oligonucleotide
  Target: ANGPTL3; (-) strand; PAM type: YTN; PAM sequence: TTA
gaccgtctttttggacagtg

SEQ ID NO: 10448 - DNA, 20 bp, Artificial Sequence
  Description of Artificial Sequence: Synthetic oligonucleotide
  Target: ANGPTL3; (-) strand; PAM type: YTN; PAM sequence: CTC
attagaccgtctttttggac

SEQ ID NO: 10449 - DNA, 20 bp, Artificial Sequence
  Description of Artificial Sequence: Synthetic oligonucleotide
  Target: ANGPTL3; (-) strand; PAM type: YTN; PAM sequence: TTG
tctcattagaccgtcttttt

SEQ ID NO: 10450 - DNA, 20 bp, Artificial Sequence
  Description of Artificial Sequence: Synthetic oligonucleotide
  Target: ANGPTL3; (-) strand; PAM type: YTN; PAM sequence: CTC
aattgtctcattagaccgtc

SEQ ID NO: 10451 - DNA, 20 bp, Artificial Sequence
  Description of Artificial Sequence: Synthetic oligonucleotide
  Target: ANGPTL3; (-) strand; PAM type: YTN; PAM sequence: CTA
tcaagtgctcaattgtctca

SEQ ID NO: 10452 - DNA, 20 bp, Artificial Sequence
  Description of Artificial Sequence: Synthetic oligonucleotide
  Target: ANGPTL3; (-) strand; PAM type: YTN; PAM sequence: CTC
acctatcaagtgctcaattg

SEQ ID NO: 10453 - DNA, 20 bp, Artificial Sequence
  Description of Artificial Sequence: Synthetic oligonucleotide
  Target: ANGPTL3; (-) strand; PAM type: YTN; PAM sequence: TTA
gaaccactcacctatcaagt

SEQ ID NO: 10454 - DNA, 20 bp, Artificial Sequence
  Description of Artificial Sequence: Synthetic oligonucleotide
  Target: ANGPTL3; (-) strand; PAM type: YTN; PAM sequence: CTC
agttagaaccactcacctat

SEQ ID NO: 10455 - DNA, 20 bp, Artificial Sequence
  Description of Artificial Sequence: Synthetic oligonucleotide
  Target: ANGPTL3; (-) strand; PAM type: YTN; PAM sequence: CTG
agaacatatctcagttagaa

SEQ ID NO: 10456 - DNA, 20 bp, Artificial Sequence
  Description of Artificial Sequence: Synthetic oligonucleotide
  Target: ANGPTL3; (-) strand; PAM type: YTN; PAM sequence: TTA
tactgagaacatatctcagt

SEQ ID NO: 10457 - DNA, 20 bp, Artificial Sequence
  Description of Artificial Sequence: Synthetic oligonucleotide
  Target: ANGPTL3; (-) strand; PAM type: YTN; PAM sequence: TTT
atactgagaacatatctcag

SEQ ID NO: 10458 - DNA, 20 bp, Artificial Sequence
  Description of Artificial Sequence: Synthetic oligonucleotide
  Target: ANGPTL3; (-) strand; PAM type: YTN; PAM sequence: TTT
tatactgagaacatatctca

SEQ ID NO: 10459 - DNA, 20 bp, Artificial Sequence
  Description of Artificial Sequence: Synthetic oligonucleotide
  Target: ANGPTL3; (-) strand; PAM type: YTN; PAM sequence: TTG
tatgttttatactgagaaca

SEQ ID NO: 10460 - DNA, 20 bp, Artificial Sequence
  Description of Artificial Sequence: Synthetic oligonucleotide
  Target: ANGPTL3; (-) strand; PAM type: YTN; PAM sequence: CTA
ttgtatgttttatactgaga

SEQ ID NO: 10461 - DNA, 20 bp, Artificial Sequence
  Description of Artificial Sequence: Synthetic oligonucleotide
  Target: ANGPTL3; (-) strand; PAM type: YTN; PAM sequence: TTG
tataggaagatcctattgta

SEQ ID NO: 10462 - DNA, 20 bp, Artificial Sequence
  Description of Artificial Sequence: Synthetic oligonucleotide
  Target: ANGPTL3; (-) strand; PAM type: YTN; PAM sequence: TTA
atgttgtataggaagatcct

SEQ ID NO: 10463 - DNA, 20 bp, Artificial Sequence
  Description of Artificial Sequence: Synthetic oligonucleotide
  Target: ANGPTL3; (-) strand; PAM type: YTN; PAM sequence: TTA
attaatgttgtataggaaga

SEQ ID NO: 10464 - DNA, 20 bp, Artificial Sequence
  Description of Artificial Sequence: Synthetic oligonucleotide
  Target: ANGPTL3; (-) strand; PAM type: YTN; PAM sequence: TTT
aattaatgttgtataggaag

SEQ ID NO: 10465 - DNA, 20 bp, Artificial Sequence
  Description of Artificial Sequence: Synthetic oligonucleotide
  Target: ANGPTL3; (-) strand; PAM type: YTN; PAM sequence: TTT
taattaatgttgtataggaa

SEQ ID NO: 10466 - DNA, 20 bp, Artificial Sequence
  Description of Artificial Sequence: Synthetic oligonucleotide
  Target: ANGPTL3; (-) strand; PAM type: YTN; PAM sequence: TTT
ttaattaatgttgtatagga

SEQ ID NO: 10467 - DNA, 20 bp, Artificial Sequence
  Description of Artificial Sequence: Synthetic oligonucleotide
  Target: ANGPTL3; (-) strand; PAM type: YTN; PAM sequence: TTT
tttaattaatgttgtatagg

SEQ ID NO: 10468 - DNA, 20 bp, Artificial Sequence
  Description of Artificial Sequence: Synthetic oligonucleotide
  Target: ANGPTL3; (-) strand; PAM type: YTN; PAM sequence: TTG
ttttttaattaatgttgtat

SEQ ID NO: 10469 - DNA, 20 bp, Artificial Sequence
  Description of Artificial Sequence: Synthetic oligonucleotide
  Target: ANGPTL3; (-) strand; PAM type: YTN; PAM sequence: TTT
gttttttaattaatgttgta

SEQ ID NO: 10470 - DNA, 20 bp, Artificial Sequence
  Description of Artificial Sequence: Synthetic oligonucleotide
  Target: ANGPTL3; (-) strand; PAM type: YTN; PAM sequence: CTA
caatagtttgttttttaatt

SEQ ID NO: 10471 - DNA, 20 bp, Artificial Sequence
  Description of Artificial Sequence: Synthetic oligonucleotide
  Target: ANGPTL3; (-) strand; PAM type: YTN; PAM sequence: TTA
actacaatagtttgtttttt

SEQ ID NO: 10472 - DNA, 20 bp, Artificial Sequence
  Description of Artificial Sequence: Synthetic oligonucleotide
  Target: ANGPTL3; (-) strand; PAM type: YTN; PAM sequence: TTT
aactacaatagtttgttttt

SEQ ID NO: 10473 - DNA, 20 bp, Artificial Sequence
  Description of Artificial Sequence: Synthetic oligonucleotide
  Target: ANGPTL3; (-) strand; PAM type: YTN; PAM sequence: TTT
taactacaatagtttgtttt

SEQ ID NO: 10474 - DNA, 20 bp, Artificial Sequence
  Description of Artificial Sequence: Synthetic oligonucleotide
  Target: ANGPTL3; (-) strand; PAM type: YTN; PAM sequence: TTT
ttaactacaatagtttgttt

SEQ ID NO: 10475 - DNA, 20 bp, Artificial Sequence
  Description of Artificial Sequence: Synthetic oligonucleotide
  Target: ANGPTL3; (-) strand; PAM type: YTN; PAM sequence: CTT
tttaactacaatagtttgtt

SEQ ID NO: 10476 - DNA, 20 bp, Artificial Sequence
  Description of Artificial Sequence: Synthetic oligonucleotide
  Target: ANGPTL3; (-) strand; PAM type: YTN; PAM sequence: TTC
ctttttaactacaatagttt

SEQ ID NO: 10477 - DNA, 20 bp, Artificial Sequence
  Description of Artificial Sequence: Synthetic oligonucleotide
  Target: ANGPTL3; (-) strand; PAM type: YTN; PAM sequence: TTT
cctttttaactacaatagtt

SEQ ID NO: 10478 - DNA, 20 bp, Artificial Sequence
  Description of Artificial Sequence: Synthetic oligonucleotide
  Target: ANGPTL3; (-) strand; PAM type: YTN; PAM sequence: TTT
tcctttttaactacaatagt

SEQ ID NO: 10479 - DNA, 20 bp, Artificial Sequence
  Description of Artificial Sequence: Synthetic oligonucleotide
  Target: ANGPTL3; (-) strand; PAM type: YTN; PAM sequence: TTT
ttcctttttaactacaatag

SEQ ID NO: 10480 - DNA, 20 bp, Artificial Sequence
  Description of Artificial Sequence: Synthetic oligonucleotide
  Target: ANGPTL3; (-) strand; PAM type: YTN; PAM sequence: TTT
tttcctttttaactacaata

SEQ ID NO: 10481 - DNA, 20 bp, Artificial Sequence
  Description of Artificial Sequence: Synthetic oligonucleotide
  Target: ANGPTL3; (-) strand; PAM type: YTN; PAM sequence: CTA
attttttcctttttaactac

SEQ ID NO: 10482 - DNA, 20 bp, Artificial Sequence
  Description of Artificial Sequence: Synthetic oligonucleotide
  Target: ANGPTL3; (-) strand; PAM type: YTN; PAM sequence: CTC
taattttttcctttttaact

SEQ ID NO: 10483 - DNA, 20 bp, Artificial Sequence
  Description of Artificial Sequence: Synthetic oligonucleotide
  Target: ANGPTL3; (-) strand; PAM type: YTN; PAM sequence: TTA
catagtatctctaatttttt

SEQ ID NO: 10484 - DNA, 20 bp, Artificial Sequence
  Description of Artificial Sequence: Synthetic oligonucleotide
  Target: ANGPTL3; (-) strand; PAM type: YTN; PAM sequence: TTT
acatagtatctctaattttt

SEQ ID NO: 10485 - DNA, 20 bp, Artificial Sequence
  Description of Artificial Sequence: Synthetic oligonucleotide
  Target: ANGPTL3; (-) strand; PAM type: YTN; PAM sequence: TTT
tacatagtatctctaatttt

SEQ ID NO: 10486 - DNA, 20 bp, Artificial Sequence
  Description of Artificial Sequence: Synthetic oligonucleotide
  Target: ANGPTL3; (-) strand; PAM type: YTN; PAM sequence: TTT
ttacatagtatctctaattt

SEQ ID NO: 10487 - DNA, 20 bp, Artificial Sequence
  Description of Artificial Sequence: Synthetic oligonucleotide
  Target: ANGPTL3; (-) strand; PAM type: YTN; PAM sequence: TTT
tttacatagtatctctaatt

SEQ ID NO: 10488 - DNA, 20 bp, Artificial Sequence
  Description of Artificial Sequence: Synthetic oligonucleotide
  Target: ANGPTL3; (-) strand; PAM type: YTN; PAM sequence: CTT
ttttacatagtatctctaat

SEQ ID NO: 10489 - DNA, 20 bp, Artificial Sequence
  Description of Artificial Sequence: Synthetic oligonucleotide
  Target: ANGPTL3; (-) strand; PAM type: YTN; PAM sequence: CTC
ttttttacatagtatctcta

SEQ ID NO: 10490 - DNA, 20 bp, Artificial Sequence
  Description of Artificial Sequence: Synthetic oligonucleotide
  Target: ANGPTL3; (-) strand; PAM type: YTN; PAM sequence: TTG
gctcttttttacatagtatc

SEQ ID NO: 10491 - DNA, 20 bp, Artificial Sequence
  Description of Artificial Sequence: Synthetic oligonucleotide
  Target: ANGPTL3; (-) strand; PAM type: YTN; PAM sequence: TTT
ggctcttttttacatagtat

SEQ ID NO: 10492 - DNA, 20 bp, Artificial Sequence
  Description of Artificial Sequence: Synthetic oligonucleotide
  Target: ANGPTL3; (-) strand; PAM type: YTN; PAM sequence: TTT
tggctcttttttacatagta

SEQ ID NO: 10493 - DNA, 20 bp, Artificial Sequence
  Description of Artificial Sequence: Synthetic oligonucleotide
  Target: ANGPTL3; (-) strand; PAM type: YTN; PAM sequence: TTC
aaataaaatacaaggtattt

SEQ ID NO: 10494 - DNA, 20 bp, Artificial Sequence
  Description of Artificial Sequence: Synthetic oligonucleotide
  Target: ANGPTL3; (-) strand; PAM type: YTN; PAM sequence: TTT
caaataaaatacaaggtatt

SEQ ID NO: 10495 - DNA, 20 bp, Artificial Sequence
  Description of Artificial Sequence: Synthetic oligonucleotide
  Target: ANGPTL3; (-) strand; PAM type: YTN; PAM sequence: CTT
tcaaataaaatacaaggtat

SEQ ID NO: 10496 - DNA, 20 bp, Artificial Sequence
  Description of Artificial Sequence: Synthetic oligonucleotide
  Target: ANGPTL3; (-) strand; PAM type: YTN; PAM sequence: TTA
tggagatatgtctttcaaat

SEQ ID NO: 10497 - DNA, 20 bp, Artificial Sequence
  Description of Artificial Sequence: Synthetic oligonucleotide
  Target: ANGPTL3; (-) strand; PAM type: YTN; PAM sequence: CTT
atggagatatgtctttcaaa

SEQ ID NO: 10498 - DNA, 20 bp, Artificial Sequence
  Description of Artificial Sequence: Synthetic oligonucleotide
  Target: ANGPTL3; (-) strand; PAM type: YTN; PAM sequence: TTG
tgtaatcttatggagatatg

SEQ ID NO: 10499 - DNA, 20 bp, Artificial Sequence
  Description of Artificial Sequence: Synthetic oligonucleotide
  Target: ANGPTL3; (-) strand; PAM type: YTN; PAM sequence: CTA
cacgaggttgtgtaatctta

SEQ ID NO: 10500 - DNA, 20 bp, Artificial Sequence
  Description of Artificial Sequence: Synthetic oligonucleotide
  Target: ANGPTL3; (-) strand; PAM type: YTN; PAM sequence: TTA
tcctacacgaggttgtgtaa

SEQ ID NO: 10501 - DNA, 20 bp, Artificial Sequence
  Description of Artificial Sequence: Synthetic oligonucleotide
  Target: ANGPTL3; (-) strand; PAM type: YTN; PAM sequence: TTT
atcctacacgaggttgtgta

SEQ ID NO: 10502 - DNA, 20 bp, Artificial Sequence
  Description of Artificial Sequence: Synthetic oligonucleotide
  Target: ANGPTL3; (-) strand; PAM type: YTN; PAM sequence: CTT
tatcctacacgaggttgtgt

SEQ ID NO: 10503 - DNA, 20 bp, Artificial Sequence
  Description of Artificial Sequence: Synthetic oligonucleotide
  Target: ANGPTL3; (-) strand; PAM type: YTN; PAM sequence: TTC
caagcaaagcaaagtccttt

SEQ ID NO: 10504 - DNA, 20 bp, Artificial Sequence
  Description of Artificial Sequence: Synthetic oligonucleotide
  Target: ANGPTL3; (-) strand; PAM type: YTN; PAM sequence: TTA
aattccaagcaaagcaaagt

SEQ ID NO: 10505 - DNA, 20 bp, Artificial Sequence
  Description of Artificial Sequence: Synthetic oligonucleotide
  Target: ANGPTL3; (-) strand; PAM type: YTN; PAM sequence: TTT
aaattccaagcaaagcaaag

SEQ ID NO: 10506 - DNA, 20 bp, Artificial Sequence
  Description of Artificial Sequence: Synthetic oligonucleotide
  Target: ANGPTL3; (-) strand; PAM type: YTN; PAM sequence: TTG
tttaaattccaagcaaagca

SEQ ID NO: 10507 - DNA, 20 bp, Artificial Sequence
  Description of Artificial Sequence: Synthetic oligonucleotide
  Target: ANGPTL3; (-) strand; PAM type: YTN; PAM sequence: CTA
aattgtttaaattccaagca

SEQ ID NO: 10508 - DNA, 20 bp, Artificial Sequence
  Description of Artificial Sequence: Synthetic oligonucleotide
  Target: ANGPTL3; (-) strand; PAM type: YTN; PAM sequence: TTA
agagcctaaattgtttaaat

SEQ ID NO: 10509 - DNA, 20 bp, Artificial Sequence
  Description of Artificial Sequence: Synthetic oligonucleotide
  Target: ANGPTL3; (-) strand; PAM type: YTN; PAM sequence: TTT
aagagcctaaattgtttaaa

SEQ ID NO: 10510 - DNA, 20 bp, Artificial Sequence
  Description of Artificial Sequence: Synthetic oligonucleotide
  Target: ANGPTL3; (-) strand; PAM type: YTN; PAM sequence: TTA
ggacatttaagagcctaaat

SEQ ID NO: 10511 - DNA, 20 bp, Artificial Sequence
  Description of Artificial Sequence: Synthetic oligonucleotide
  Target: ANGPTL3; (-) strand; PAM type: YTN; PAM sequence: TTT
aggacatttaagagcctaaa

SEQ ID NO: 10512 - DNA, 20 bp, Artificial Sequence
  Description of Artificial Sequence: Synthetic oligonucleotide
  Target: ANGPTL3; (-) strand; PAM type: YTN; PAM sequence: TTT
taggacatttaagagcctaa

SEQ ID NO: 10513 - DNA, 20 bp, Artificial Sequence
  Description of Artificial Sequence: Synthetic oligonucleotide
  Target: ANGPTL3; (-) strand; PAM type: YTN; PAM sequence: CTA
cagagaattttaggacattt

SEQ ID NO: 10514 - DNA, 20 bp, Artificial Sequence
  Description of Artificial Sequence: Synthetic oligonucleotide
  Target: ANGPTL3; (-) strand; PAM type: YTN; PAM sequence: TTA
gctacagagaattttaggac

SEQ ID NO: 10515 - DNA, 20 bp, Artificial Sequence
  Description of Artificial Sequence: Synthetic oligonucleotide
  Target: ANGPTL3; (-) strand; PAM type: YTN; PAM sequence: CTT
agctacagagaattttagga

SEQ ID NO: 10516 - DNA, 20 bp, Artificial Sequence
  Description of Artificial Sequence: Synthetic oligonucleotide
  Target: ANGPTL3; (-) strand; PAM type: YTN; PAM sequence: TTC
ttagctacagagaattttag

SEQ ID NO: 10517 - DNA, 20 bp, Artificial Sequence
  Description of Artificial Sequence: Synthetic oligonucleotide
  Target: ANGPTL3; (-) strand; PAM type: YTN; PAM sequence: TTT
cttagctacagagaatttta

SEQ ID NO: 10518 - DNA, 20 bp, Artificial Sequence
  Description of Artificial Sequence: Synthetic oligonucleotide
  Target: ANGPTL3; (-) strand; PAM type: YTN; PAM sequence: CTA
ggaaccaatataaaaatttc

SEQ ID NO: 10519 - DNA, 20 bp, Artificial Sequence
  Description of Artificial Sequence: Synthetic oligonucleotide
  Target: ANGPTL3; (-) strand; PAM type: YTN; PAM sequence: TTC
ctaggaaccaatataaaaat

SEQ ID NO: 10520 - DNA, 20 bp, Artificial Sequence
  Description of Artificial Sequence: Synthetic oligonucleotide
  Target: ANGPTL3; (-) strand; PAM type: YTN; PAM sequence: CTA
gttcctaggaaccaatataa

SEQ ID NO: 10521 - DNA, 20 bp, Artificial Sequence
  Description of Artificial Sequence: Synthetic oligonucleotide
  Target: ANGPTL3; (-) strand; PAM type: YTN; PAM sequence: TTC
ctagttcctaggaaccaata

SEQ ID NO: 10522 - DNA, 20 bp, Artificial Sequence
  Description of Artificial Sequence: Synthetic oligonucleotide
  Target: ANGPTL3; (-) strand; PAM type: YTN; PAM sequence: TTA
aggattcctagttcctagga

SEQ ID NO: 10523 - DNA, 20 bp, Artificial Sequence
  Description of Artificial Sequence: Synthetic oligonucleotide
  Target: ANGPTL3; (-) strand; PAM type: YTN; PAM sequence: TTT
aaggattcctagttcctagg

SEQ ID NO: 10524 - DNA, 20 bp, Artificial Sequence
  Description of Artificial Sequence: Synthetic oligonucleotide
  Target: ANGPTL3; (-) strand; PAM type: YTN; PAM sequence: CTA
atttaaggattcctagttcc

SEQ ID NO: 10525 - DNA, 20 bp, Artificial Sequence
  Description of Artificial Sequence: Synthetic oligonucleotide
  Target: ANGPTL3; (-) strand; PAM type: YTN; PAM sequence: TTG
taagcaaatgtagggcctaa

SEQ ID NO: 10526 - DNA, 20 bp, Artificial Sequence
  Description of Artificial Sequence: Synthetic oligonucleotide
  Target: ANGPTL3; (-) strand; PAM type: YTN; PAM sequence: CTT
gtaagcaaatgtagggccta

SEQ ID NO: 10527 - DNA, 20 bp, Artificial Sequence
  Description of Artificial Sequence: Synthetic oligonucleotide
  Target: ANGPTL3; (-) strand; PAM type: YTN; PAM sequence: TTA
tgccaaggaaaataaacttg

SEQ ID NO: 10528 - DNA, 20 bp, Artificial Sequence
  Description of Artificial Sequence: Synthetic oligonucleotide
  Target: ANGPTL3; (-) strand; PAM type: YTN; PAM sequence: TTT
atgccaaggaaaataaactt

SEQ ID NO: 10529 - DNA, 20 bp, Artificial Sequence
  Description of Artificial Sequence: Synthetic oligonucleotide
  Target: ANGPTL3; (-) strand; PAM type: YTN; PAM sequence: TTT
tatgccaaggaaaataaact

SEQ ID NO: 10530 - DNA, 20 bp, Artificial Sequence
  Description of Artificial Sequence: Synthetic oligonucleotide
  Target: ANGPTL3; (-) strand; PAM type: YTN; PAM sequence: CTA
aaaaattttatgccaaggaa

SEQ ID NO: 10531 - DNA, 20 bp, Artificial Sequence
  Description of Artificial Sequence: Synthetic oligonucleotide
  Target: ANGPTL3; (-) strand; PAM type: YTN; PAM sequence: CTG
atcaaatataaccagtaatg

SEQ ID NO: 10532 - DNA, 20 bp, Artificial Sequence
  Description of Artificial Sequence: Synthetic oligonucleotide
  Target: ANGPTL3; (-) strand; PAM type: YTN; PAM sequence: TTA
aatagaaccctgatcaaata

SEQ ID NO: 10533 - DNA, 20 bp, Artificial Sequence
  Description of Artificial Sequence: Synthetic oligonucleotide
  Target: ANGPTL3; (-) strand; PAM type: YTN; PAM sequence: TTT
aaatagaaccctgatcaaat

SEQ ID NO: 10534 - DNA, 20 bp, Artificial Sequence
  Description of Artificial Sequence: Synthetic oligonucleotide
  Target: ANGPTL3; (-) strand; PAM type: YTN; PAM sequence: CTA
tttaaatagaaccctgatca

SEQ ID NO: 10535 - DNA, 20 bp, Artificial Sequence
  Description of Artificial Sequence: Synthetic oligonucleotide
  Target: ANGPTL3; (-) strand; PAM type: YTN; PAM sequence: TTG
tgcctatttaaatagaaccc

SEQ ID NO: 10536 - DNA, 20 bp, Artificial Sequence
  Description of Artificial Sequence: Synthetic oligonucleotide
  Target: ANGPTL3; (-) strand; PAM type: YTN; PAM sequence: CTT
gtgcctatttaaatagaacc

SEQ ID NO: 10537 - DNA, 20 bp, Artificial Sequence
  Description of Artificial Sequence: Synthetic oligonucleotide
  Target: ANGPTL3; (-) strand; PAM type: YTN; PAM sequence: TTG
aacttgtgcctatttaaata

SEQ ID NO: 10538 - DNA, 20 bp, Artificial Sequence
  Description of Artificial Sequence: Synthetic oligonucleotide
  Target: ANGPTL3; (-) strand; PAM type: YTN; PAM sequence: CTT
gaacttgtgcctatttaaat

SEQ ID NO: 10539 - DNA, 20 bp, Artificial Sequence
  Description of Artificial Sequence: Synthetic oligonucleotide
  Target: ANGPTL3; (-) strand; PAM type: YTN; PAM sequence: TTG
cttgaacttgtgcctattta

SEQ ID NO: 10540 - DNA, 20 bp, Artificial Sequence
  Description of Artificial Sequence: Synthetic oligonucleotide
  Target: ANGPTL3; (-) strand; PAM type: YTN; PAM sequence: TTT
gcttgaacttgtgcctattt

SEQ ID NO: 10541 - DNA, 20 bp, Artificial Sequence
  Description of Artificial Sequence: Synthetic oligonucleotide
  Target: ANGPTL3; (-) strand; PAM type: YTN; PAM sequence: CTT
tgcttgaacttgtgcctatt

SEQ ID NO: 10542 - DNA, 20 bp, Artificial Sequence
  Description of Artificial Sequence: Synthetic oligonucleotide
  Target: ANGPTL3; (-) strand; PAM type: YTN; PAM sequence: CTG
atctttgcttgaacttgtgc

SEQ ID NO: 10543 - DNA, 20 bp, Artificial Sequence
  Description of Artificial Sequence: Synthetic oligonucleotide
  Target: ANGPTL3; (-) strand; PAM type: YTN; PAM sequence: CTA
aaagcagaatctgatctttg

SEQ ID NO: 10544 - DNA, 20 bp, Artificial Sequence
  Description of Artificial Sequence: Synthetic oligonucleotide
  Target: ANGPTL3; (-) strand; PAM type: YTN; PAM sequence: CTG
ctaaaagcagaatctgatct

SEQ ID NO: 10545 - DNA, 20 bp, Artificial Sequence
  Description of Artificial Sequence: Synthetic oligonucleotide
  Target: ANGPTL3; (-) strand; PAM type: YTN; PAM sequence: CTG
agtacacactgctaaaagca

SEQ ID NO: 10546 - DNA, 20 bp, Artificial Sequence
  Description of Artificial Sequence: Synthetic oligonucleotide
  Target: ANGPTL3; (-) strand; PAM type: YTN; PAM sequence: CTG
tctgagtacacactgctaaa

SEQ ID NO: 10547 - DNA, 20 bp, Artificial Sequence
  Description of Artificial Sequence: Synthetic oligonucleotide
  Target: ANGPTL3; (-) strand; PAM type: YTN; PAM sequence: TTC
ctgtctgagtacacactgct

SEQ ID NO: 10548 - DNA, 20 bp, Artificial Sequence
  Description of Artificial Sequence: Synthetic oligonucleotide
  Target: ANGPTL3; (-) strand; PAM type: YTN; PAM sequence: CTT
cctgtctgagtacacactgc

SEQ ID NO: 10549 - DNA, 20 bp, Artificial Sequence
  Description of Artificial Sequence: Synthetic oligonucleotide
  Target: ANGPTL3; (-) strand; PAM type: YTN; PAM sequence: TTA
atacttcctgtctgagtaca

SEQ ID NO: 10550 - DNA, 20 bp, Artificial Sequence
  Description of Artificial Sequence: Synthetic oligonucleotide
  Target: ANGPTL3; (-) strand; PAM type: YTN; PAM sequence: TTT
aatacttcctgtctgagtac

SEQ ID NO: 10551 - DNA, 20 bp, Artificial Sequence
  Description of Artificial Sequence: Synthetic oligonucleotide
  Target: ANGPTL3; (-) strand; PAM type: YTN; PAM sequence: TTT
taatacttcctgtctgagta

SEQ ID NO: 10552 - DNA, 20 bp, Artificial Sequence
  Description of Artificial Sequence: Synthetic oligonucleotide
  Target: ANGPTL3; (-) strand; PAM type: YTN; PAM sequence: CTT
ttaatacttcctgtctgagt

SEQ ID NO: 10553 - DNA, 20 bp, Artificial Sequence
  Description of Artificial Sequence: Synthetic oligonucleotide
  Target: ANGPTL3; (-) strand; PAM type: YTN; PAM sequence: CTG
ccttttaatacttcctgtct

SEQ ID NO: 10554 - DNA, 20 bp, Artificial Sequence
  Description of Artificial Sequence: Synthetic oligonucleotide
  Target: ANGPTL3; (-) strand; PAM type: YTN; PAM sequence: CTG
cctgccttttaatacttcct

SEQ ID NO: 10555 - DNA, 20 bp, Artificial Sequence
  Description of Artificial Sequence: Synthetic oligonucleotide
  Target: ANGPTL3; (-) strand; PAM type: YTN; PAM sequence: TTC
tgcctgccttttaatacttc

SEQ ID NO: 10556 - DNA, 20 bp, Artificial Sequence
  Description of Artificial Sequence: Synthetic oligonucleotide
  Target: ANGPTL3; (-) strand; PAM type: YTN; PAM sequence: TTT
ctgcctgccttttaatactt

SEQ ID NO: 10557 - DNA, 20 bp, Artificial Sequence
  Description of Artificial Sequence: Synthetic oligonucleotide
  Target: ANGPTL3; (-) strand; PAM type: YTN; PAM sequence: TTT
tctgcctgccttttaatact

SEQ ID NO: 10558 - DNA, 20 bp, Artificial Sequence
  Description of Artificial Sequence: Synthetic oligonucleotide
  Target: ANGPTL3; (-) strand; PAM type: YTN; PAM sequence: TTA
taaaggattttctgcctgcc

SEQ ID NO: 10559 - DNA, 20 bp, Artificial Sequence
  Description of Artificial Sequence: Synthetic oligonucleotide
  Target: ANGPTL3; (-) strand; PAM type: YTN; PAM sequence: TTT
ataaaggattttctgcctgc

SEQ ID NO: 10560 - DNA, 20 bp, Artificial Sequence
  Description of Artificial Sequence: Synthetic oligonucleotide
  Target: ANGPTL3; (-) strand; PAM type: YTN; PAM sequence: TTT
tataaaggattttctgcctg

SEQ ID NO: 10561 - DNA, 20 bp, Artificial Sequence
  Description of Artificial Sequence: Synthetic oligonucleotide
  Target: ANGPTL3; (-) strand; PAM type: YTN; PAM sequence: TTG
aaagtagtaattttataaag

SEQ ID NO: 10562 - DNA, 20 bp, Artificial Sequence
  Description of Artificial Sequence: Synthetic oligonucleotide
  Target: ANGPTL3; (-) strand; PAM type: YTN; PAM sequence: TTC
aacgtgggaaaatgcattga

SEQ ID NO: 10563 - DNA, 20 bp, Artificial Sequence
  Description of Artificial Sequence: Synthetic oligonucleotide
  Target: ANGPTL3; (-) strand; PAM type: YTN; PAM sequence: TTT
caacgtgggaaaatgcattg

SEQ ID NO: 10564 - DNA, 20 bp, Artificial Sequence
  Description of Artificial Sequence: Synthetic oligonucleotide
  Target: ANGPTL3; (-) strand; PAM type: YTN; PAM sequence: CTG
cagaagcatttcaacgtggg

SEQ ID NO: 10565 - DNA, 20 bp, Artificial Sequence
  Description of Artificial Sequence: Synthetic oligonucleotide
  Target: ANGPTL3; (-) strand; PAM type: YTN; PAM sequence: TTA
taaactgcagaagcatttca

SEQ ID NO: 10566 - DNA, 20 bp, Artificial Sequence
  Description of Artificial Sequence: Synthetic oligonucleotide
  Target: ANGPTL3; (-) strand; PAM type: YTN; PAM sequence: CTA
attataaactgcagaagcat

SEQ ID NO: 10567 - DNA, 20 bp, Artificial Sequence
  Description of Artificial Sequence: Synthetic oligonucleotide
  Target: ANGPTL3; (-) strand; PAM type: YTN; PAM sequence: TTG
cctaattataaactgcagaa

SEQ ID NO: 10568 - DNA, 20 bp, Artificial Sequence
  Description of Artificial Sequence: Synthetic oligonucleotide
  Target: ANGPTL3; (-) strand; PAM type: YTN; PAM sequence: TTT
gcctaattataaactgcaga

SEQ ID NO: 10569 - DNA, 20 bp, Artificial Sequence
  Description of Artificial Sequence: Synthetic oligonucleotide
  Target: ANGPTL3; (-) strand; PAM type: YTN; PAM sequence: TTA
aagtaatttgcctaattata

SEQ ID NO: 10570 - DNA, 20 bp, Artificial Sequence
  Description of Artificial Sequence: Synthetic oligonucleotide
  Target: ANGPTL3; (-) strand; PAM type: YTN; PAM sequence: TTA
taattaaagtaatttgccta

SEQ ID NO: 10571 - DNA, 20 bp, Artificial Sequence
  Description of Artificial Sequence: Synthetic oligonucleotide
  Target: ANGPTL3; (-) strand; PAM type: YTN; PAM sequence: TTG
attataattaaagtaatttg

SEQ ID NO: 10572 - DNA, 20 bp, Artificial Sequence
  Description of Artificial Sequence: Synthetic oligonucleotide
  Target: ANGPTL3; (-) strand; PAM type: YTN; PAM sequence: TTA
ttgattataattaaagtaat

SEQ ID NO: 10573 - DNA, 20 bp, Artificial Sequence
  Description of Artificial Sequence: Synthetic oligonucleotide
  Target: ANGPTL3; (-) strand; PAM type: YTN; PAM sequence: TTG
aacagcattattgattataa

SEQ ID NO: 10574 - DNA, 20 bp, Artificial Sequence
  Description of Artificial Sequence: Synthetic oligonucleotide
  Target: ANGPTL3; (-) strand; PAM type: YTN; PAM sequence: TTT
gaacagcattattgattata

SEQ ID NO: 10575 - DNA, 20 bp, Artificial Sequence
  Description of Artificial Sequence: Synthetic oligonucleotide
  Target: ANGPTL3; (-) strand; PAM type: YTN; PAM sequence: TTA
tagtaatttgaacagcatta

SEQ ID NO: 10576 - DNA, 20 bp, Artificial Sequence
  Description of Artificial Sequence: Synthetic oligonucleotide
  Target: ANGPTL3; (-) strand; PAM type: YTN; PAM sequence: CTT
atagtaatttgaacagcatt

SEQ ID NO: 10577 - DNA, 20 bp, Artificial Sequence
  Description of Artificial Sequence: Synthetic oligonucleotide
  Target: ANGPTL3; (-) strand; PAM type: YTN; PAM sequence: TTC
ttatagtaatttgaacagca

SEQ ID NO: 10578 - DNA, 20 bp, Artificial Sequence
  Description of Artificial Sequence: Synthetic oligonucleotide
  Target: ANGPTL3; (-) strand; PAM type: YTN; PAM sequence: CTG
tataattcttatagtaattt

SEQ ID NO: 10579 - DNA, 20 bp, Artificial Sequence
  Description of Artificial Sequence: Synthetic oligonucleotide
  Target: ANGPTL3; (-) strand; PAM type: YTN; PAM sequence: TTG
gtataaatatctgtataatt

SEQ ID NO: 10580 - DNA, 20 bp, Artificial Sequence
  Description of Artificial Sequence: Synthetic oligonucleotide
  Target: ANGPTL3; (-) strand; PAM type: YTN; PAM sequence: CTT
ggtataaatatctgtataat

SEQ ID NO: 10581 - DNA, 20 bp, Artificial Sequence
  Description of Artificial Sequence: Synthetic oligonucleotide
  Target: ANGPTL3; (-) strand; PAM type: YTN; PAM sequence: CTC
ttggtataaatatctgtata

SEQ ID NO: 10582 - DNA, 20 bp, Artificial Sequence
  Description of Artificial Sequence: Synthetic oligonucleotide
  Target: ANGPTL3; (-) strand; PAM type: YTN; PAM sequence: TTG
tctcttggtataaatatctg

SEQ ID NO: 10583 - DNA, 20 bp, Artificial Sequence
  Description of Artificial Sequence: Synthetic oligonucleotide
  Target: ANGPTL3; (-) strand; PAM type: YTN; PAM sequence: CTA
gtatattgtctcttggtata

SEQ ID NO: 10584 - DNA, 20 bp, Artificial Sequence
  Description of Artificial Sequence: Synthetic oligonucleotide
  Target: ANGPTL3; (-) strand; PAM type: YTN; PAM sequence: TTC
tagtatattgtctcttggta

SEQ ID NO: 10585 - DNA, 20 bp, Artificial Sequence
  Description of Artificial Sequence: Synthetic oligonucleotide
  Target: ANGPTL3; (-) strand; PAM type: YTN; PAM sequence: TTT
ctagtatattgtctcttggt

SEQ ID NO: 10586 - DNA, 20 bp, Artificial Sequence
  Description of Artificial Sequence: Synthetic oligonucleotide
  Target: ANGPTL3; (-) strand; PAM type: YTN; PAM sequence: TTG
gtttctagtatattgtctct

SEQ ID NO: 10587 - DNA, 20 bp, Artificial Sequence
  Description of Artificial Sequence: Synthetic oligonucleotide
  Target: ANGPTL3; (-) strand; PAM type: YTN; PAM sequence: CTT
ggtttctagtatattgtctc

SEQ ID NO: 10588 - DNA, 20 bp, Artificial Sequence
  Description of Artificial Sequence: Synthetic oligonucleotide
  Target: ANGPTL3; (-) strand; PAM type: YTN; PAM sequence: CTG
acagagtagaggtaatggtc

SEQ ID NO: 10589 - DNA, 20 bp, Artificial Sequence
  Description of Artificial Sequence: Synthetic oligonucleotide
  Target: ANGPTL3; (-) strand; PAM type: YTN; PAM sequence: CTC
acaaataacactgacagagt

SEQ ID NO: 10590 - DNA, 20 bp, Artificial Sequence
  Description of Artificial Sequence: Synthetic oligonucleotide
  Target: ANGPTL3; (-) strand; PAM type: YTN; PAM sequence: TTC
tcacaaataacactgacaga

SEQ ID NO: 10591 - DNA, 20 bp, Artificial Sequence
  Description of Artificial Sequence: Synthetic oligonucleotide
  Target: ANGPTL3; (-) strand; PAM type: YTN; PAM sequence: TTT
ctcacaaataacactgacag

SEQ ID NO: 10592 - DNA, 20 bp, Artificial Sequence
  Description of Artificial Sequence: Synthetic oligonucleotide
  Target: ANGPTL3; (-) strand; PAM type: YTN; PAM sequence: TTG
tgcaatttctcacaaataac

SEQ ID NO: 10593 - DNA, 20 bp, Artificial Sequence
  Description of Artificial Sequence: Synthetic oligonucleotide
  Target: ANGPTL3; (-) strand; PAM type: YTN; PAM sequence: TTT
gtgcaatttctcacaaataa

SEQ ID NO: 10594 - DNA, 20 bp, Artificial Sequence
  Description of Artificial Sequence: Synthetic oligonucleotide
  Target: ANGPTL3; (-) strand; PAM type: YTN; PAM sequence: TTG
caaaatttgtgcaatttctc

SEQ ID NO: 10595 - DNA, 20 bp, Artificial Sequence
  Description of Artificial Sequence: Synthetic oligonucleotide
  Target: ANGPTL3; (-) strand; PAM type: YTN; PAM sequence: TTT
gcaaaatttgtgcaatttct

SEQ ID NO: 10596 - DNA, 20 bp, Artificial Sequence
  Description of Artificial Sequence: Synthetic oligonucleotide
  Target: ANGPTL3; (-) strand; PAM type: YTN; PAM sequence: TTT
tgcaaaatttgtgcaatttc

SEQ ID NO: 10597 - DNA, 20 bp, Artificial Sequence
  Description of Artificial Sequence: Synthetic oligonucleotide
  Target: ANGPTL3; (-) strand; PAM type: YTN; PAM sequence: TTT
ttgcaaaatttgtgcaattt

SEQ ID NO: 10598 - DNA, 20 bp, Artificial Sequence
  Description of Artificial Sequence: Synthetic oligonucleotide
  Target: ANGPTL3; (-) strand; PAM type: YTN; PAM sequence: CTT
tttgcaaaatttgtgcaatt

SEQ ID NO: 10599 - DNA, 20 bp, Artificial Sequence
  Description of Artificial Sequence: Synthetic oligonucleotide
  Target: ANGPTL3; (-) strand; PAM type: YTN; PAM sequence: CTA
acactttttgcaaaatttgt

SEQ ID NO: 10600 - DNA, 20 bp, Artificial Sequence
  Description of Artificial Sequence: Synthetic oligonucleotide
  Target: ANGPTL3; (-) strand; PAM type: YTN; PAM sequence: CTG
tagtaggatactaacacttt

SEQ ID NO: 10601 - DNA, 20 bp, Artificial Sequence
  Description of Artificial Sequence: Synthetic oligonucleotide
  Target: ANGPTL3; (-) strand; PAM type: YTN; PAM sequence: CTA
ctgtagtaggatactaacac

SEQ ID NO: 10602 - DNA, 20 bp, Artificial Sequence
  Description of Artificial Sequence: Synthetic oligonucleotide
  Target: ANGPTL3; (-) strand; PAM type: YTN; PAM sequence: TTA
tatcctactgtagtaggata

SEQ ID NO: 10603 - DNA, 20 bp, Artificial Sequence
  Description of Artificial Sequence: Synthetic oligonucleotide
  Target: ANGPTL3; (-) strand; PAM type: YTN; PAM sequence: CTA
tattatatcctactgtagta

SEQ ID NO: 10604 - DNA, 20 bp, Artificial Sequence
  Description of Artificial Sequence: Synthetic oligonucleotide
  Target: ANGPTL3; (-) strand; PAM type: YTN; PAM sequence: TTC
tatattatatcctactgtag

SEQ ID NO: 10605 - DNA, 20 bp, Artificial Sequence
  Description of Artificial Sequence: Synthetic oligonucleotide
  Target: ANGPTL3; (-) strand; PAM type: YTN; PAM sequence: CTT
ctatattatatcctactgta

SEQ ID NO: 10606 - DNA, 20 bp, Artificial Sequence
  Description of Artificial Sequence: Synthetic oligonucleotide
  Target: ANGPTL3; (-) strand; PAM type: YTN; PAM sequence: TTC
cttctatattatatcctact

SEQ ID NO: 10607 - DNA, 20 bp, Artificial Sequence
  Description of Artificial Sequence: Synthetic oligonucleotide
  Target: ANGPTL3; (-) strand; PAM type: YTN; PAM sequence: TTT
ccttctatattatatcctac

SEQ ID NO: 10608 - DNA, 20 bp, Artificial Sequence
  Description of Artificial Sequence: Synthetic oligonucleotide
  Target: ANGPTL3; (-) strand; PAM type: YTN; PAM sequence: TTA
tttccttctatattatatcc

SEQ ID NO: 10609 - DNA, 20 bp, Artificial Sequence
  Description of Artificial Sequence: Synthetic oligonucleotide
  Target: ANGPTL3; (-) strand; PAM type: YTN; PAM sequence: TTA
tgaaattatttccttctata

SEQ ID NO: 10610 - DNA, 20 bp, Artificial Sequence
  Description of Artificial Sequence: Synthetic oligonucleotide
  Target: ANGPTL3; (-) strand; PAM type: YTN; PAM sequence: TTT
atgaaattatttccttctat

SEQ ID NO: 10611 - DNA, 20 bp, Artificial Sequence
  Description of Artificial Sequence: Synthetic oligonucleotide
  Target: ANGPTL3; (-) strand; PAM type: YTN; PAM sequence: CTT
tatgaaattatttccttcta

SEQ ID NO: 10612 - DNA, 20 bp, Artificial Sequence
  Description of Artificial Sequence: Synthetic oligonucleotide
  Target: ANGPTL3; (-) strand; PAM type: YTN; PAM sequence: CTA
gtaccaaagacaggctttat

SEQ ID NO: 10613 - DNA, 20 bp, Artificial Sequence
  Description of Artificial Sequence: Synthetic oligonucleotide
  Target: ANGPTL3; (-) strand; PAM type: YTN; PAM sequence: CTG
agcactagtaccaaagacag

SEQ ID NO: 10614 - DNA, 20 bp, Artificial Sequence
  Description of Artificial Sequence: Synthetic oligonucleotide
  Target: ANGPTL3; (-) strand; PAM type: YTN; PAM sequence: TTA
atgaaagtaactgagcacta

SEQ ID NO: 10615 - DNA, 20 bp, Artificial Sequence
  Description of Artificial Sequence: Synthetic oligonucleotide
  Target: ANGPTL3; (-) strand; PAM type: YTN; PAM sequence: TTA
gttaatgaaagtaactgagc

SEQ ID NO: 10616 - DNA, 20 bp, Artificial Sequence
  Description of Artificial Sequence: Synthetic oligonucleotide
  Target: ANGPTL3; (-) strand; PAM type: YTN; PAM sequence: TTT
agttaatgaaagtaactgag

SEQ ID NO: 10617 - DNA, 20 bp, Artificial Sequence
  Description of Artificial Sequence: Synthetic oligonucleotide
  Target: ANGPTL3; (-) strand; PAM type: YTN; PAM sequence: TTT
tagttaatgaaagtaactga

SEQ ID NO: 10618 - DNA, 20 bp, Artificial Sequence
  Description of Artificial Sequence: Synthetic oligonucleotide
  Target: ANGPTL3; (-) strand; PAM type: YTN; PAM sequence: TTT
ttagttaatgaaagtaactg

SEQ ID NO: 10619 - DNA, 20 bp, Artificial Sequence
  Description of Artificial Sequence: Synthetic oligonucleotide
  Target: ANGPTL3; (-) strand; PAM type: YTN; PAM sequence: TTT
tttagttaatgaaagtaact

SEQ ID NO: 10620 - DNA, 20 bp, Artificial Sequence
  Description of Artificial Sequence: Synthetic oligonucleotide
  Target: ANGPTL3; (-) strand; PAM type: YTN; PAM sequence: CTT
ttttagttaatgaaagtaac

SEQ ID NO: 10621 - DNA, 20 bp, Artificial Sequence
  Description of Artificial Sequence: Synthetic oligonucleotide
  Target: ANGPTL3; (-) strand; PAM type: YTN; PAM sequence: TTG
aagagtagccccttttttag

SEQ ID NO: 10622 - DNA, 20 bp, Artificial Sequence
  Description of Artificial Sequence: Synthetic oligonucleotide
  Target: ANGPTL3; (-) strand; PAM type: YTN; PAM sequence: TTT
gaagagtagcccctttttta

SEQ ID NO: 10623 - DNA, 20 bp, Artificial Sequence
  Description of Artificial Sequence: Synthetic oligonucleotide
  Target: ANGPTL3; (-) strand; PAM type: YTN; PAM sequence: TTA
gagaagggaatttgaagagt

SEQ ID NO: 10624 - DNA, 20 bp, Artificial Sequence
  Description of Artificial Sequence: Synthetic oligonucleotide
  Target: ANGPTL3; (-) strand; PAM type: YTN; PAM sequence: TTT
agagaagggaatttgaagag

SEQ ID NO: 10625 - DNA, 20 bp, Artificial Sequence
  Description of Artificial Sequence: Synthetic oligonucleotide
  Target: ANGPTL3; (-) strand; PAM type: YTN; PAM sequence: TTT
tagagaagggaatttgaaga

SEQ ID NO: 10626 - DNA, 20 bp, Artificial Sequence
  Description of Artificial Sequence: Synthetic oligonucleotide
  Target: ANGPTL3; (-) strand; PAM type: YTN; PAM sequence: TTT
ttagagaagggaatttgaag

SEQ ID NO: 10627 - DNA, 20 bp, Artificial Sequence
  Description of Artificial Sequence: Synthetic oligonucleotide
  Target: ANGPTL3; (-) strand; PAM type: YTN; PAM sequence: CTT
tttagagaagggaatttgaa

SEQ ID NO: 10628 - DNA, 20 bp, Artificial Sequence
  Description of Artificial Sequence: Synthetic oligonucleotide
  Target: ANGPTL3; (-) strand; PAM type: YTN; PAM sequence: TTC
tttttagagaagggaatttg

SEQ ID NO: 10629 - DNA, 20 bp, Artificial Sequence
  Description of Artificial Sequence: Synthetic oligonucleotide
  Target: ANGPTL3; (-) strand; PAM type: YTN; PAM sequence: TTG
atatagtacattctttttag

SEQ ID NO: 10630 - DNA, 20 bp, Artificial Sequence
  Description of Artificial Sequence: Synthetic oligonucleotide
  Target: ANGPTL3; (-) strand; PAM type: YTN; PAM sequence: TTT
gatatagtacattcttttta

SEQ ID NO: 10631 - DNA, 20 bp, Artificial Sequence
  Description of Artificial Sequence: Synthetic oligonucleotide
  Target: ANGPTL3; (-) strand; PAM type: YTN; PAM sequence: TTT
tgatatagtacattcttttt

SEQ ID NO: 10632 - DNA, 20 bp, Artificial Sequence
  Description of Artificial Sequence: Synthetic oligonucleotide
  Target: ANGPTL3; (-) strand; PAM type: YTN; PAM sequence: CTT
ttgatatagtacattctttt

SEQ ID NO: 10633 - DNA, 20 bp, Artificial Sequence
  Description of Artificial Sequence: Synthetic oligonucleotide
  Target: ANGPTL3; (-) strand; PAM type: YTN; PAM sequence: TTA
cccccttttgatatagtaca

SEQ ID NO: 10634 - DNA, 20 bp, Artificial Sequence
  Description of Artificial Sequence: Synthetic oligonucleotide
  Target: ANGPTL3; (-) strand; PAM type: YTN; PAM sequence: TTT
acccccttttgatatagtac

SEQ ID NO: 10635 - DNA, 20 bp, Artificial Sequence
  Description of Artificial Sequence: Synthetic oligonucleotide
  Target: ANGPTL3; (-) strand; PAM type: YTN; PAM sequence: CTA
agtgcagaatgtatacgtag

SEQ ID NO: 10636 - DNA, 20 bp, Artificial Sequence
  Description of Artificial Sequence: Synthetic oligonucleotide
  Target: ANGPTL3; (-) strand; PAM type: YTN; PAM sequence: TTC
taagtgcagaatgtatacgt

SEQ ID NO: 10637 - DNA, 20 bp, Artificial Sequence
  Description of Artificial Sequence: Synthetic oligonucleotide
  Target: ANGPTL3; (-) strand; PAM type: YTN; PAM sequence: TTT
ctaagtgcagaatgtatacg

SEQ ID NO: 10638 - DNA, 20 bp, Artificial Sequence
  Description of Artificial Sequence: Synthetic oligonucleotide
  Target: ANGPTL3; (-) strand; PAM type: YTN; PAM sequence: TTG
aataagagaatgataaaatc

SEQ ID NO: 10639 - DNA, 20 bp, Artificial Sequence
  Description of Artificial Sequence: Synthetic oligonucleotide
  Target: ANGPTL3; (-) strand; PAM type: YTN; PAM sequence: TTA
ttgaataagagaatgataaa

SEQ ID NO: 10640 - DNA, 20 bp, Artificial Sequence
  Description of Artificial Sequence: Synthetic oligonucleotide
  Target: ANGPTL3; (-) strand; PAM type: YTN; PAM sequence: TTT
attgaataagagaatgataa

SEQ ID NO: 10641 - DNA, 20 bp, Artificial Sequence
  Description of Artificial Sequence: Synthetic oligonucleotide
  Target: ANGPTL3; (-) strand; PAM type: YTN; PAM sequence: TTG
tagaaacaatatttattgaa

SEQ ID NO: 10642 - DNA, 20 bp, Artificial Sequence
  Description of Artificial Sequence: Synthetic oligonucleotide
  Target: ANGPTL3; (-) strand; PAM type: YTN; PAM sequence: TTA
cacattgtagaaacaatatt

SEQ ID NO: 10643 - DNA, 20 bp, Artificial Sequence
  Description of Artificial Sequence: Synthetic oligonucleotide
  Target: ANGPTL3; (-) strand; PAM type: YTN; PAM sequence: CTT
acacattgtagaaacaatat

SEQ ID NO: 10644 - DNA, 20 bp, Artificial Sequence
  Description of Artificial Sequence: Synthetic oligonucleotide
  Target: ANGPTL3; (-) strand; PAM type: YTN; PAM sequence: TTA
gtacagtaatgccttacaca

SEQ ID NO: 10645 - DNA, 20 bp, Artificial Sequence
  Description of Artificial Sequence: Synthetic oligonucleotide
  Target: ANGPTL3; (-) strand; PAM type: YTN; PAM sequence: TTT
agtacagtaatgccttacac

SEQ ID NO: 10646 - DNA, 20 bp, Artificial Sequence
  Description of Artificial Sequence: Synthetic oligonucleotide
  Target: ANGPTL3; (-) strand; PAM type: YTN; PAM sequence: CTT
tagtacagtaatgccttaca

SEQ ID NO: 10647 - DNA, 20 bp, Artificial Sequence
  Description of Artificial Sequence: Synthetic oligonucleotide
  Target: ANGPTL3; (-) strand; PAM type: YTN; PAM sequence: TTA
taatgctttagtacagtaat

SEQ ID NO: 10648 - DNA, 20 bp, Artificial Sequence
  Description of Artificial Sequence: Synthetic oligonucleotide
  Target: ANGPTL3; (-) strand; PAM type: YTN; PAM sequence: CTT
ataatgctttagtacagtaa

SEQ ID NO: 10649 - DNA, 20 bp, Artificial Sequence
  Description of Artificial Sequence: Synthetic oligonucleotide
  Target: ANGPTL3; (-) strand; PAM type: YTN; PAM sequence: TTC
cttataatgctttagtacag

SEQ ID NO: 10650 - DNA, 20 bp, Artificial Sequence
  Description of Artificial Sequence: Synthetic oligonucleotide
  Target: ANGPTL3; (-) strand; PAM type: YTN; PAM sequence: TTA
tattccttataatgctttag

SEQ ID NO: 10651 - DNA, 20 bp, Artificial Sequence
  Description of Artificial Sequence: Synthetic oligonucleotide
  Target: ANGPTL3; (-) strand; PAM type: YTN; PAM sequence: CTT
atattccttataatgcttta

SEQ ID NO: 10652 - DNA, 20 bp, Artificial Sequence
  Description of Artificial Sequence: Synthetic oligonucleotide
  Target: ANGPTL3; (-) strand; PAM type: YTN; PAM sequence: TTA
acttatattccttataatgc

SEQ ID NO: 10653 - DNA, 20 bp, Artificial Sequence
  Description of Artificial Sequence: Synthetic oligonucleotide
  Target: ANGPTL3; (-) strand; PAM type: YTN; PAM sequence: TTT
aacttatattccttataatg

SEQ ID NO: 10654 - DNA, 20 bp, Artificial Sequence
  Description of Artificial Sequence: Synthetic oligonucleotide
  Target: ANGPTL3; (-) strand; PAM type: YTN; PAM sequence: TTT
taacttatattccttataat

SEQ ID NO: 10655 - DNA, 20 bp, Artificial Sequence
  Description of Artificial Sequence: Synthetic oligonucleotide
  Target: ANGPTL3; (-) strand; PAM type: YTN; PAM sequence: TTT
ttaacttatattccttataa

SEQ ID NO: 10656 - DNA, 20 bp, Artificial Sequence
  Description of Artificial Sequence: Synthetic oligonucleotide
  Target: ANGPTL3; (-) strand; PAM type: YTN; PAM sequence: TTG
tatgtgtttttaacttatat

SEQ ID NO: 10657 - DNA, 20 bp, Artificial Sequence
  Description of Artificial Sequence: Synthetic oligonucleotide
  Target: ANGPTL3; (-) strand; PAM type: YTN; PAM sequence: TTT
gtatgtgtttttaacttata

SEQ ID NO: 10658 - DNA, 20 bp, Artificial Sequence
  Description of Artificial Sequence: Synthetic oligonucleotide
  Target: ANGPTL3; (-) strand; PAM type: YTN; PAM sequence: TTG
gcaagatttgtatgtgtttt

SEQ ID NO: 10659 - DNA, 20 bp, Artificial Sequence
  Description of Artificial Sequence: Synthetic oligonucleotide
  Target: ANGPTL3; (-) strand; PAM type: YTN; PAM sequence: TTG
attggcaagatttgtatgtg

SEQ ID NO: 10660 - DNA, 20 bp, Artificial Sequence
  Description of Artificial Sequence: Synthetic oligonucleotide
  Target: ANGPTL3; (-) strand; PAM type: YTN; PAM sequence: CTG
ttgattggcaagatttgtat

SEQ ID NO: 10661 - DNA, 20 bp, Artificial Sequence
  Description of Artificial Sequence: Synthetic oligonucleotide
  Target: ANGPTL3; (-) strand; PAM type: YTN; PAM sequence: CTA
taagctgttgattggcaaga

SEQ ID NO: 10662 - DNA, 20 bp, Artificial Sequence
  Description of Artificial Sequence: Synthetic oligonucleotide
  Target: ANGPTL3; (-) strand; PAM type: YTN; PAM sequence: TTA
cactataagctgttgattgg

SEQ ID NO: 10663 - DNA, 20 bp, Artificial Sequence
  Description of Artificial Sequence: Synthetic oligonucleotide
  Target: ANGPTL3; (-) strand; PAM type: YTN; PAM sequence: CTA
ttacactataagctgttgat

SEQ ID NO: 10664 - DNA, 20 bp, Artificial Sequence
  Description of Artificial Sequence: Synthetic oligonucleotide
  Target: ANGPTL3; (-) strand; PAM type: YTN; PAM sequence: CTC
ccctattacactataagctg

SEQ ID NO: 10665 - DNA, 20 bp, Artificial Sequence
  Description of Artificial Sequence: Synthetic oligonucleotide
  Target: ANGPTL3; (-) strand; PAM type: YTN; PAM sequence: CTC
tcccctattacactataagc

SEQ ID NO: 10666 - DNA, 20 bp, Artificial Sequence
  Description of Artificial Sequence: Synthetic oligonucleotide
  Target: ANGPTL3; (-) strand; PAM type: YTN; PAM sequence: TTC
tctcccctattacactataa

SEQ ID NO: 10667 - DNA, 20 bp, Artificial Sequence
  Description of Artificial Sequence: Synthetic oligonucleotide
  Target: ANGPTL3; (-) strand; PAM type: YTN; PAM sequence: CTT
ctctcccctattacactata

SEQ ID NO: 10668 - DNA, 20 bp, Artificial Sequence
  Description of Artificial Sequence: Synthetic oligonucleotide
  Target: ANGPTL3; (-) strand; PAM type: YTN; PAM sequence: TTG
agggagaatatagatgggcc

SEQ ID NO: 10669 - DNA, 20 bp, Artificial Sequence
  Description of Artificial Sequence: Synthetic oligonucleotide
  Target: ANGPTL3; (-) strand; PAM type: YTN; PAM sequence: CTA
gttgagggagaatatagatg

SEQ ID NO: 10670 - DNA, 20 bp, Artificial Sequence
  Description of Artificial Sequence: Synthetic oligonucleotide
  Target: ANGPTL3; (-) strand; PAM type: YTN; PAM sequence: TTG
ctagttgagggagaatatag

SEQ ID NO: 10671 - DNA, 20 bp, Artificial Sequence
  Description of Artificial Sequence: Synthetic oligonucleotide
  Target: ANGPTL3; (-) strand; PAM type: YTN; PAM sequence: CTT
gctagttgagggagaatata

SEQ ID NO: 10672 - DNA, 20 bp, Artificial Sequence
  Description of Artificial Sequence: Synthetic oligonucleotide
  Target: ANGPTL3; (-) strand; PAM type: YTN; PAM sequence: TTC
atccacttgctagttgaggg

SEQ ID NO: 10673 - DNA, 20 bp, Artificial Sequence
  Description of Artificial Sequence: Synthetic oligonucleotide
  Target: ANGPTL3; (-) strand; PAM type: YTN; PAM sequence: TTT
catccacttgctagttgagg

SEQ ID NO: 10674 - DNA, 20 bp, Artificial Sequence
  Description of Artificial Sequence: Synthetic oligonucleotide
  Target: ANGPTL3; (-) strand; PAM type: YTN; PAM sequence: CTG
atatttcatccacttgctag

SEQ ID NO: 10675 - DNA, 20 bp, Artificial Sequence
  Description of Artificial Sequence: Synthetic oligonucleotide
  Target: ANGPTL3; (-) strand; PAM type: YTN; PAM sequence: TTG
accctgatatttcatccact

SEQ ID NO: 10676 - DNA, 20 bp, Artificial Sequence
  Description of Artificial Sequence: Synthetic oligonucleotide
  Target: ANGPTL3; (-) strand; PAM type: YTN; PAM sequence: CTA
ttgaccctgatatttcatcc

SEQ ID NO: 10677 - DNA, 20 bp, Artificial Sequence
  Description of Artificial Sequence: Synthetic oligonucleotide
  Target: ANGPTL3; (-) strand; PAM type: YTN; PAM sequence: TTA
taactattgaccctgatatt

SEQ ID NO: 10678 - DNA, 20 bp, Artificial Sequence
  Description of Artificial Sequence: Synthetic oligonucleotide
  Target: ANGPTL3; (-) strand; PAM type: YTN; PAM sequence: CTT
ataactattgaccctgatat

SEQ ID NO: 10679 - DNA, 20 bp, Artificial Sequence
  Description of Artificial Sequence: Synthetic oligonucleotide
  Target: ANGPTL3; (-) strand; PAM type: YTN; PAM sequence: TTG
tggcttataactattgaccc

SEQ ID NO: 10680 - DNA, 20 bp, Artificial Sequence
  Description of Artificial Sequence: Synthetic oligonucleotide
  Target: ANGPTL3; (-) strand; PAM type: YTN; PAM sequence: TTT
gtggcttataactattgacc

SEQ ID NO: 10681 - DNA, 20 bp, Artificial Sequence
  Description of Artificial Sequence: Synthetic oligonucleotide
  Target: ANGPTL3; (-) strand; PAM type: YTN; PAM sequence: TTT
tgtggcttataactattgac

SEQ ID NO: 10682 - DNA, 20 bp, Artificial Sequence
  Description of Artificial Sequence: Synthetic oligonucleotide
  Target: ANGPTL3; (-) strand; PAM type: YTN; PAM sequence: CTT
ttgtggcttataactattga

SEQ ID NO: 10683 - DNA, 20 bp, Artificial Sequence
  Description of Artificial Sequence: Synthetic oligonucleotide
  Target: ANGPTL3; (-) strand; PAM type: YTN; PAM sequence: CTG
tcagcttttgtggcttataa

SEQ ID NO: 10684 - DNA, 20 bp, Artificial Sequence
  Description of Artificial Sequence: Synthetic oligonucleotide
  Target: ANGPTL3; (-) strand; PAM type: YTN; PAM sequence: TTA
agctgtcagcttttgtggct

SEQ ID NO: 10685 - DNA, 20 bp, Artificial Sequence
  Description of Artificial Sequence: Synthetic oligonucleotide
  Target: ANGPTL3; (-) strand; PAM type: YTN; PAM sequence: TTA
attaagctgtcagcttttgt

SEQ ID NO: 10686 - DNA, 20 bp, Artificial Sequence
  Description of Artificial Sequence: Synthetic oligonucleotide
  Target: ANGPTL3; (-) strand; PAM type: YTN; PAM sequence: CTT
aattaagctgtcagcttttg

SEQ ID NO: 10687 - DNA, 20 bp, Artificial Sequence
  Description of Artificial Sequence: Synthetic oligonucleotide
  Target: ANGPTL3; (-) strand; PAM type: YTN; PAM sequence: CTC
ttaattaagctgtcagcttt

SEQ ID NO: 10688 - DNA, 20 bp, Artificial Sequence
  Description of Artificial Sequence: Synthetic oligonucleotide
  Target: ANGPTL3; (-) strand; PAM type: YTN; PAM sequence: TTC
tcttaattaagctgtcagct

SEQ ID NO: 10689 - DNA, 20 bp, Artificial Sequence
  Description of Artificial Sequence: Synthetic oligonucleotide
  Target: ANGPTL3; (-) strand; PAM type: YTN; PAM sequence: CTT
ctcttaattaagctgtcagc

SEQ ID NO: 10690 - DNA, 20 bp, Artificial Sequence
  Description of Artificial Sequence: Synthetic oligonucleotide
  Target: ANGPTL3; (-) strand; PAM type: YTN; PAM sequence: TTC
aaaacttctcttaattaagc

SEQ ID NO: 10691 - DNA, 20 bp, Artificial Sequence
  Description of Artificial Sequence: Synthetic oligonucleotide
  Target: ANGPTL3; (-) strand; PAM type: YTN; PAM sequence: TTT
caaaacttctcttaattaag

SEQ ID NO: 10692 - DNA, 20 bp, Artificial Sequence
  Description of Artificial Sequence: Synthetic oligonucleotide
  Target: ANGPTL3; (-) strand; PAM type: YTN; PAM sequence: TTG
gtcatgaaatacatatttca

SEQ ID NO: 10693 - DNA, 20 bp, Artificial Sequence
  Description of Artificial Sequence: Synthetic oligonucleotide
  Target: ANGPTL3; (-) strand; PAM type: YTN; PAM sequence: TTA
ttggtcatgaaatacatatt

SEQ ID NO: 10694 - DNA, 20 bp, Artificial Sequence
  Description of Artificial Sequence: Synthetic oligonucleotide
  Target: ANGPTL3; (-) strand; PAM type: YTN; PAM sequence: TTG
taattattggtcatgaaata

SEQ ID NO: 10695 - DNA, 20 bp, Artificial Sequence
  Description of Artificial Sequence: Synthetic oligonucleotide
  Target: ANGPTL3; (-) strand; PAM type: YTN; PAM sequence: TTA
cagttgtaattattggtcat

SEQ ID NO: 10696 - DNA, 20 bp, Artificial Sequence
  Description of Artificial Sequence: Synthetic oligonucleotide
  Target: ANGPTL3; (-) strand; PAM type: YTN; PAM sequence: TTA
aatagaaaagttacagttgt

SEQ ID NO: 10697 - DNA, 20 bp, Artificial Sequence
  Description of Artificial Sequence: Synthetic oligonucleotide
  Target: ANGPTL3; (-) strand; PAM type: YTN; PAM sequence: TTT
aaatagaaaagttacagttg

SEQ ID NO: 10698 - DNA, 20 bp, Artificial Sequence
  Description of Artificial Sequence: Synthetic oligonucleotide
  Target: ANGPTL3; (-) strand; PAM type: YTN; PAM sequence: CTT
taaatagaaaagttacagtt

SEQ ID NO: 10699 - DNA, 20 bp, Artificial Sequence
  Description of Artificial Sequence: Synthetic oligonucleotide
  Target: ANGPTL3; (-) strand; PAM type: YTN; PAM sequence: TTC
tttaaatagaaaagttacag

SEQ ID NO: 10700 - DNA, 20 bp, Artificial Sequence
  Description of Artificial Sequence: Synthetic oligonucleotide
  Target: ANGPTL3; (-) strand; PAM type: YTN; PAM sequence: CTT
ctttaaatagaaaagttaca

SEQ ID NO: 10701 - DNA, 20 bp, Artificial Sequence
  Description of Artificial Sequence: Synthetic oligonucleotide
  Target: ANGPTL3; (-) strand; PAM type: YTN; PAM sequence: CTC
cttctttaaatagaaaagtt

SEQ ID NO: 10702 - DNA, 20 bp, Artificial Sequence
  Description of Artificial Sequence: Synthetic oligonucleotide
  Target: ANGPTL3; (-) strand; PAM type: YTN; PAM sequence: TTC
tccttctttaaatagaaaag

SEQ ID NO: 10703 - DNA, 20 bp, Artificial Sequence
  Description of Artificial Sequence: Synthetic oligonucleotide
  Target: ANGPTL3; (-) strand; PAM type: YTN; PAM sequence: TTT
ctccttctttaaatagaaaa

SEQ ID NO: 10704 - DNA, 20 bp, Artificial Sequence
  Description of Artificial Sequence: Synthetic oligonucleotide
  Target: ANGPTL3; (-) strand; PAM type: YTN; PAM sequence: TTT
tctccttctttaaatagaaa

SEQ ID NO: 10705 - DNA, 20 bp, Artificial Sequence
  Description of Artificial Sequence: Synthetic oligonucleotide
  Target: ANGPTL3; (-) strand; PAM type: YTN; PAM sequence: TTC
aaattttctccttctttaaa

SEQ ID NO: 10706 - DNA, 20 bp, Artificial Sequence
  Description of Artificial Sequence: Synthetic oligonucleotide
  Target: ANGPTL3; (-) strand; PAM type: YTN; PAM sequence: CTA
gagaagaaattcaaattttc

SEQ ID NO: 10707 - DNA, 20 bp, Artificial Sequence
  Description of Artificial Sequence: Synthetic oligonucleotide
  Target: ANGPTL3; (-) strand; PAM type: YTN; PAM sequence: TTG
agctagagaagaaattcaaa

SEQ ID NO: 10708 - DNA, 20 bp, Artificial Sequence
  Description of Artificial Sequence: Synthetic oligonucleotide
  Target: ANGPTL3; (-) strand; PAM type: YTN; PAM sequence: TTA
tagaagtgtatgttgagcta

SEQ ID NO: 10709 - DNA, 20 bp, Artificial Sequence
  Description of Artificial Sequence: Synthetic oligonucleotide
  Target: ANGPTL3; (-) strand; PAM type: YTN; PAM sequence: TTC
atgtaatggaattatagaag

SEQ ID NO: 10710 - DNA, 20 bp, Artificial Sequence
  Description of Artificial Sequence: Synthetic oligonucleotide
  Target: ANGPTL3; (-) strand; PAM type: YTN; PAM sequence: CTG
gttcatgtaatggaattata

SEQ ID NO: 10711 - DNA, 20 bp, Artificial Sequence
  Description of Artificial Sequence: Synthetic oligonucleotide
  Target: ANGPTL3; (-) strand; PAM type: YTN; PAM sequence: CTC
tggttcatgtaatggaatta

SEQ ID NO: 10712 - DNA, 20 bp, Artificial Sequence
  Description of Artificial Sequence: Synthetic oligonucleotide
  Target: ANGPTL3; (-) strand; PAM type: YTN; PAM sequence: TTA
ctctggttcatgtaatggaa

SEQ ID NO: 10713 - DNA, 20 bp, Artificial Sequence
  Description of Artificial Sequence: Synthetic oligonucleotide
  Target: ANGPTL3; (-) strand; PAM type: YTN; PAM sequence: TTT
actctggttcatgtaatgga

SEQ ID NO: 10714 - DNA, 20 bp, Artificial Sequence
  Description of Artificial Sequence: Synthetic oligonucleotide
  Target: ANGPTL3; (-) strand; PAM type: YTN; PAM sequence: CTT
tactctggttcatgtaatgg

SEQ ID NO: 10715 - DNA, 20 bp, Artificial Sequence
  Description of Artificial Sequence: Synthetic oligonucleotide
  Target: ANGPTL3; (-) strand; PAM type: YTN; PAM sequence: TTA
ccctttactctggttcatgt

SEQ ID NO: 10716 - DNA, 20 bp, Artificial Sequence
  Description of Artificial Sequence: Synthetic oligonucleotide
  Target: ANGPTL3; (-) strand; PAM type: YTN; PAM sequence: CTT
accctttactctggttcatg

SEQ ID NO: 10717 - DNA, 20 bp, Artificial Sequence
  Description of Artificial Sequence: Synthetic oligonucleotide
  Target: ANGPTL3; (-) strand; PAM type: YTN; PAM sequence: TTC
catcttaccctttactctgg

SEQ ID NO: 10718 - DNA, 20 bp, Artificial Sequence
  Description of Artificial Sequence: Synthetic oligonucleotide
  Target: ANGPTL3; (-) strand; PAM type: YTN; PAM sequence: TTT
ccatcttaccctttactctg

SEQ ID NO: 10719 - DNA, 20 bp, Artificial Sequence
  Description of Artificial Sequence: Synthetic oligonucleotide
  Target: ANGPTL3; (-) strand; PAM type: YTN; PAM sequence: TTC
atttccatcttaccctttac

SEQ ID NO: 10720 - DNA, 20 bp, Artificial Sequence
  Description of Artificial Sequence: Synthetic oligonucleotide
  Target: ANGPTL3; (-) strand; PAM type: YTN; PAM sequence: CTT
catttccatcttacccttta

SEQ ID NO: 10721 - DNA, 20 bp, Artificial Sequence
  Description of Artificial Sequence: Synthetic oligonucleotide
  Target: ANGPTL3; (-) strand; PAM type: YTN; PAM sequence: TTC
ttcatttccatcttaccctt

SEQ ID NO: 10722 - DNA, 20 bp, Artificial Sequence
  Description of Artificial Sequence: Synthetic oligonucleotide
  Target: ANGPTL3; (-) strand; PAM type: YTN; PAM sequence: TTA
agtgtccaatatagaaccac

SEQ ID NO: 10723 - DNA, 20 bp, Artificial Sequence
  Description of Artificial Sequence: Synthetic oligonucleotide
  Target: ANGPTL3; (-) strand; PAM type: YTN; PAM sequence: TTT
aagtgtccaatatagaacca

SEQ ID NO: 10724 - DNA, 20 bp, Artificial Sequence
  Description of Artificial Sequence: Synthetic oligonucleotide
  Target: ANGPTL3; (-) strand; PAM type: YTN; PAM sequence: TTT
taagtgtccaatatagaacc

SEQ ID NO: 10725 - DNA, 20 bp, Artificial Sequence
  Description of Artificial Sequence: Synthetic oligonucleotide
  Target: ANGPTL3; (-) strand; PAM type: YTN; PAM sequence: TTT
ttaagtgtccaatatagaac

SEQ ID NO: 10726 - DNA, 20 bp, Artificial Sequence
  Description of Artificial Sequence: Synthetic oligonucleotide
  Target: ANGPTL3; (-) strand; PAM type: YTN; PAM sequence: TTG
tgtatgatttttaagtgtcc

SEQ ID NO: 10727 - DNA, 20 bp, Artificial Sequence
  Description of Artificial Sequence: Synthetic oligonucleotide
  Target: ANGPTL3; (-) strand; PAM type: YTN; PAM sequence: TTA
ggttgtgtatgatttttaag

SEQ ID NO: 10728 - DNA, 20 bp, Artificial Sequence
  Description of Artificial Sequence: Synthetic oligonucleotide
  Target: ANGPTL3; (-) strand; PAM type: YTN; PAM sequence: TTG
attaggttgtgtatgatttt

SEQ ID NO: 10729 - DNA, 20 bp, Artificial Sequence
  Description of Artificial Sequence: Synthetic oligonucleotide
  Target: ANGPTL3; (-) strand; PAM type: YTN; PAM sequence: TTT
gattaggttgtgtatgattt

SEQ ID NO: 10730 - DNA, 20 bp, Artificial Sequence
  Description of Artificial Sequence: Synthetic oligonucleotide
  Target: ANGPTL3; (-) strand; PAM type: YTN; PAM sequence: TTT
tgattaggttgtgtatgatt

SEQ ID NO: 10731 - DNA, 20 bp, Artificial Sequence
  Description of Artificial Sequence: Synthetic oligonucleotide
  Target: ANGPTL3; (-) strand; PAM type: YTN; PAM sequence: CTT
ttgattaggttgtgtatgat

SEQ ID NO: 10732 - DNA, 20 bp, Artificial Sequence
  Description of Artificial Sequence: Synthetic oligonucleotide
  Target: ANGPTL3; (-) strand; PAM type: YTN; PAM sequence: TTA
catcttttgattaggttgtg

SEQ ID NO: 10733 - DNA, 20 bp, Artificial Sequence
  Description of Artificial Sequence: Synthetic oligonucleotide
  Target: ANGPTL3; (-) strand; PAM type: YTN; PAM sequence: TTA
aagaattacatcttttgatt

SEQ ID NO: 10734 - DNA, 20 bp, Artificial Sequence
  Description of Artificial Sequence: Synthetic oligonucleotide
  Target: ANGPTL3; (-) strand; PAM type: YTN; PAM sequence: TTT
aaagaattacatcttttgat

SEQ ID NO: 10735 - DNA, 20 bp, Artificial Sequence
  Description of Artificial Sequence: Synthetic oligonucleotide
  Target: ANGPTL3; (-) strand; PAM type: YTN; PAM sequence: TTT
taaagaattacatcttttga

SEQ ID NO: 10736 - DNA, 20 bp, Artificial Sequence
  Description of Artificial Sequence: Synthetic oligonucleotide
  Target: ANGPTL3; (-) strand; PAM type: YTN; PAM sequence: TTT
ttaaagaattacatcttttg

SEQ ID NO: 10737 - DNA, 20 bp, Artificial Sequence
  Description of Artificial Sequence: Synthetic oligonucleotide
  Target: ANGPTL3; (-) strand; PAM type: YTN; PAM sequence: CTT
tttaaagaattacatctttt

SEQ ID NO: 10738 - DNA, 20 bp, Artificial Sequence
  Description of Artificial Sequence: Synthetic oligonucleotide
  Target: ANGPTL3; (-) strand; PAM type: YTN; PAM sequence: CTC
gtacctttttaaagaattac

SEQ ID NO: 10739 - DNA, 20 bp, Artificial Sequence
  Description of Artificial Sequence: Synthetic oligonucleotide
  Target: ANGPTL3; (-) strand; PAM type: YTN; PAM sequence: TTG
gtctcgtacctttttaaaga

SEQ ID NO: 10740 - DNA, 20 bp, Artificial Sequence
  Description of Artificial Sequence: Synthetic oligonucleotide
  Target: ANGPTL3; (-) strand; PAM type: YTN; PAM sequence: TTT
ggtctcgtacctttttaaag

SEQ ID NO: 10741 - DNA, 20 bp, Artificial Sequence
  Description of Artificial Sequence: Synthetic oligonucleotide
  Target: ANGPTL3; (-) strand; PAM type: YTN; PAM sequence: TTT
tggtctcgtacctttttaaa

SEQ ID NO: 10742 - DNA, 20 bp, Artificial Sequence
  Description of Artificial Sequence: Synthetic oligonucleotide
  Target: ANGPTL3; (-) strand; PAM type: YTN; PAM sequence: CTG
aattttggtctcgtaccttt

SEQ ID NO: 10743 - DNA, 20 bp, Artificial Sequence
  Description of Artificial Sequence: Synthetic oligonucleotide
  Target: ANGPTL3; (-) strand; PAM type: YTN; PAM sequence: TTC
tgaattttggtctcgtacct

SEQ ID NO: 10744 - DNA, 20 bp, Artificial Sequence
  Description of Artificial Sequence: Synthetic oligonucleotide
  Target: ANGPTL3; (-) strand; PAM type: YTN; PAM sequence: TTT
ctgaattttggtctcgtacc

SEQ ID NO: 10745 - DNA, 20 bp, Artificial Sequence
  Description of Artificial Sequence: Synthetic oligonucleotide
  Target: ANGPTL3; (-) strand; PAM type: YTN; PAM sequence: TTT
tctgaattttggtctcgtac

SEQ ID NO: 10746 - DNA, 20 bp, Artificial Sequence
  Description of Artificial Sequence: Synthetic oligonucleotide
  Target: ANGPTL3; (-) strand; PAM type: YTN; PAM sequence: CTA
gattttctgaattttggtct

SEQ ID NO: 10747 - DNA, 20 bp, Artificial Sequence
  Description of Artificial Sequence: Synthetic oligonucleotide
  Target: ANGPTL3; (-) strand; PAM type: YTN; PAM sequence: TTA
tagtctagattttctgaatt

SEQ ID NO: 10748 - DNA, 20 bp, Artificial Sequence
  Description of Artificial Sequence: Synthetic oligonucleotide
  Target: ANGPTL3; (-) strand; PAM type: YTN; PAM sequence: TTG
ttatagtctagattttctga

SEQ ID NO: 10749 - DNA, 20 bp, Artificial Sequence
  Description of Artificial Sequence: Synthetic oligonucleotide
  Target: ANGPTL3; (-) strand; PAM type: YTN; PAM sequence: TTT
gttatagtctagattttctg

SEQ ID NO: 10750 - DNA, 20 bp, Artificial Sequence
  Description of Artificial Sequence: Synthetic oligonucleotide
  Target: ANGPTL3; (-) strand; PAM type: YTN; PAM sequence: TTT
tgttatagtctagattttct

SEQ ID NO: 10751 - DNA, 20 bp, Artificial Sequence
  Description of Artificial Sequence: Synthetic oligonucleotide
  Target: ANGPTL3; (-) strand; PAM type: YTN; PAM sequence: TTG
agaaattttgttatagtcta

SEQ ID NO: 10752 - DNA, 20 bp, Artificial Sequence
  Description of Artificial Sequence: Synthetic oligonucleotide
  Target: ANGPTL3; (-) strand; PAM type: YTN; PAM sequence: TTA
agataatgtaaattgagaaa

SEQ ID NO: 10753 - DNA, 20 bp, Artificial Sequence
  Description of Artificial Sequence: Synthetic oligonucleotide
  Target: ANGPTL3; (-) strand; PAM type: YTN; PAM sequence: TTG
catattaagataatgtaaat

SEQ ID NO: 10754 - DNA, 20 bp, Artificial Sequence
  Description of Artificial Sequence: Synthetic oligonucleotide
  Target: ANGPTL3; (-) strand; PAM type: YTN; PAM sequence: TTA
attgcatattaagataatgt

SEQ ID NO: 10755 - DNA, 20 bp, Artificial Sequence
  Description of Artificial Sequence: Synthetic oligonucleotide
  Target: ANGPTL3; (-) strand; PAM type: YTN; PAM sequence: CTG
gtgaaaattaattgcatatt

SEQ ID NO: 10756 - DNA, 20 bp, Artificial Sequence
  Description of Artificial Sequence: Synthetic oligonucleotide
  Target: ANGPTL3; (-) strand; PAM type: YTN; PAM sequence: TTA
ctggtgaaaattaattgcat

SEQ ID NO: 10757 - DNA, 20 bp, Artificial Sequence
  Description of Artificial Sequence: Synthetic oligonucleotide
  Target: ANGPTL3; (-) strand; PAM type: YTN; PAM sequence: TTT
actggtgaaaattaattgca

SEQ ID NO: 10758 - DNA, 20 bp, Artificial Sequence
  Description of Artificial Sequence: Synthetic oligonucleotide
  Target: ANGPTL3; (-) strand; PAM type: YTN; PAM sequence: TTT
tactggtgaaaattaattgc

SEQ ID NO: 10759 - DNA, 20 bp, Artificial Sequence
  Description of Artificial Sequence: Synthetic oligonucleotide
  Target: ANGPTL3; (-) strand; PAM type: YTN; PAM sequence: CTA
tagtattttactggtgaaaa

SEQ ID NO: 10760 - DNA, 20 bp, Artificial Sequence
  Description of Artificial Sequence: Synthetic oligonucleotide
  Target: ANGPTL3; (-) strand; PAM type: YTN; PAM sequence: TTG
tacccatactatagtatttt

SEQ ID NO: 10761 - DNA, 20 bp, Artificial Sequence
  Description of Artificial Sequence: Synthetic oligonucleotide
  Target: ANGPTL3; (-) strand; PAM type: YTN; PAM sequence: TTT
gtacccatactatagtattt

SEQ ID NO: 10762 - DNA, 20 bp, Artificial Sequence
  Description of Artificial Sequence: Synthetic oligonucleotide
  Target: ANGPTL3; (-) strand; PAM type: YTN; PAM sequence: CTA
atcaatgcatttgtacccat

SEQ ID NO: 10763 - DNA, 20 bp, Artificial Sequence
  Description of Artificial Sequence: Synthetic oligonucleotide
  Target: ANGPTL3; (-) strand; PAM type: YTN; PAM sequence: TTA
gaactaatcaatgcatttgt

SEQ ID NO: 10764 - DNA, 20 bp, Artificial Sequence
  Description of Artificial Sequence: Synthetic oligonucleotide
  Target: ANGPTL3; (-) strand; PAM type: YTN; PAM sequence: TTG
taattagaactaatcaatgc

SEQ ID NO: 10765 - DNA, 20 bp, Artificial Sequence
  Description of Artificial Sequence: Synthetic oligonucleotide
  Target: ANGPTL3; (-) strand; PAM type: YTN; PAM sequence: TTT
gtaattagaactaatcaatg

SEQ ID NO: 10766 - DNA, 20 bp, Artificial Sequence
  Description of Artificial Sequence: Synthetic oligonucleotide
  Target: ANGPTL3; (-) strand; PAM type: YTN; PAM sequence: TTT
tgtaattagaactaatcaat

SEQ ID NO: 10767 - DNA, 20 bp, Artificial Sequence
  Description of Artificial Sequence: Synthetic oligonucleotide
  Target: ANGPTL3; (-) strand; PAM type: YTN; PAM sequence: TTT
ttgtaattagaactaatcaa

SEQ ID NO: 10768 - DNA, 20 bp, Artificial Sequence
  Description of Artificial Sequence: Synthetic oligonucleotide
  Target: ANGPTL3; (-) strand; PAM type: YTN; PAM sequence: TTA
gccatttttgtaattagaac

SEQ ID NO: 10769 - DNA, 20 bp, Artificial Sequence
  Description of Artificial Sequence: Synthetic oligonucleotide
  Target: ANGPTL3; (-) strand; PAM type: YTN; PAM sequence: TTA
tatattagccatttttgtaa

SEQ ID NO: 10770 - DNA, 20 bp, Artificial Sequence
  Description of Artificial Sequence: Synthetic oligonucleotide
  Target: ANGPTL3; (-) strand; PAM type: YTN; PAM sequence: CTA
cacagtattatatattagcc

SEQ ID NO: 10771 - DNA, 20 bp, Artificial Sequence
  Description of Artificial Sequence: Synthetic oligonucleotide
  Target: ANGPTL3; (-) strand; PAM type: YTN; PAM sequence: CTG
atgtatcataaacactacac

SEQ ID NO: 10772 - DNA, 20 bp, Artificial Sequence
  Description of Artificial Sequence: Synthetic oligonucleotide
  Target: ANGPTL3; (-) strand; PAM type: YTN; PAM sequence: TTA
tctgatgtatcataaacact

SEQ ID NO: 10773 - DNA, 20 bp, Artificial Sequence
  Description of Artificial Sequence: Synthetic oligonucleotide
  Target: ANGPTL3; (-) strand; PAM type: YTN; PAM sequence: TTA
gaacattatctgatgtatca

SEQ ID NO: 10774 - DNA, 20 bp, Artificial Sequence
  Description of Artificial Sequence: Synthetic oligonucleotide
  Target: ANGPTL3; (-) strand; PAM type: YTN; PAM sequence: CTT
agaacattatctgatgtatc

SEQ ID NO: 10775 - DNA, 20 bp, Artificial Sequence
  Description of Artificial Sequence: Synthetic oligonucleotide
  Target: ANGPTL3; (-) strand; PAM type: YTN; PAM sequence: TTC
agagcacttagaacattatc

SEQ ID NO: 10776 - DNA, 20 bp, Artificial Sequence
  Description of Artificial Sequence: Synthetic oligonucleotide
  Target: ANGPTL3; (-) strand; PAM type: YTN; PAM sequence: TTT
cagagcacttagaacattat

SEQ ID NO: 10777 - DNA, 20 bp, Artificial Sequence
  Description of Artificial Sequence: Synthetic oligonucleotide
  Target: ANGPTL3; (-) strand; PAM type: YTN; PAM sequence: TTT
tcagagcacttagaacatta

SEQ ID NO: 10778 - DNA, 20 bp, Artificial Sequence
  Description of Artificial Sequence: Synthetic oligonucleotide
  Target: ANGPTL3; (-) strand; PAM type: YTN; PAM sequence: TTA
tattttcagagcacttagaa

SEQ ID NO: 10779 - DNA, 20 bp, Artificial Sequence
  Description of Artificial Sequence: Synthetic oligonucleotide
  Target: ANGPTL3; (-) strand; PAM type: YTN; PAM sequence: TTT
atattttcagagcacttaga

SEQ ID NO: 10780 - DNA, 20 bp, Artificial Sequence
  Description of Artificial Sequence: Synthetic oligonucleotide
  Target: ANGPTL3; (-) strand; PAM type: YTN; PAM sequence: TTA
aaagtttatattttcagagc

SEQ ID NO: 10781 - DNA, 20 bp, Artificial Sequence
  Description of Artificial Sequence: Synthetic oligonucleotide
  Target: ANGPTL3; (-) strand; PAM type: YTN; PAM sequence: TTA
tagggtcgtataaaagatta

SEQ ID NO: 10782 - DNA, 20 bp, Artificial Sequence
  Description of Artificial Sequence: Synthetic oligonucleotide
  Target: ANGPTL3; (-) strand; PAM type: YTN; PAM sequence: TTT
atagggtcgtataaaagatt

SEQ ID NO: 10783 - DNA, 20 bp, Artificial Sequence
  Description of Artificial Sequence: Synthetic oligonucleotide
  Target: ANGPTL3; (-) strand; PAM type: YTN; PAM sequence: TTT
tatagggtcgtataaaagat

SEQ ID NO: 10784 - DNA, 20 bp, Artificial Sequence
  Description of Artificial Sequence: Synthetic oligonucleotide
  Target: ANGPTL3; (-) strand; PAM type: YTN; PAM sequence: CTA
ttttatagggtcgtataaaa

SEQ ID NO: 10785 - DNA, 20 bp, Artificial Sequence
  Description of Artificial Sequence: Synthetic oligonucleotide
  Target: ANGPTL3; (-) strand; PAM type: YTN; PAM sequence: CTC
cagtgagaataacacctatt

SEQ ID NO: 10786 - DNA, 20 bp, Artificial Sequence
  Description of Artificial Sequence: Synthetic oligonucleotide
  Target: ANGPTL3; (-) strand; PAM type: YTN; PAM sequence: CTC
tccagtgagaataacaccta

SEQ ID NO: 10787 - DNA, 20 bp, Artificial Sequence
  Description of Artificial Sequence: Synthetic oligonucleotide
  Target: ANGPTL3; (-) strand; PAM type: YTN; PAM sequence: CTC
atctctccagtgagaataac

SEQ ID NO: 10788 - DNA, 20 bp, Artificial Sequence
  Description of Artificial Sequence: Synthetic oligonucleotide
  Target: ANGPTL3; (-) strand; PAM type: YTN; PAM sequence: TTC
tcatctctccagtgagaata

SEQ ID NO: 10789 - DNA, 20 bp, Artificial Sequence
  Description of Artificial Sequence: Synthetic oligonucleotide
  Target: ANGPTL3; (-) strand; PAM type: YTN; PAM sequence: TTT
ctcatctctccagtgagaat

SEQ ID NO: 10790 - DNA, 20 bp, Artificial Sequence
  Description of Artificial Sequence: Synthetic oligonucleotide
  Target: ANGPTL3; (-) strand; PAM type: YTN; PAM sequence: TTT
tctcatctctccagtgagaa

SEQ ID NO: 10791 - DNA, 20 bp, Artificial Sequence
  Description of Artificial Sequence: Synthetic oligonucleotide
  Target: ANGPTL3; (-) strand; PAM type: YTN; PAM sequence: CTG
ttttctcatctctccagtga

SEQ ID NO: 10792 - DNA, 20 bp, Artificial Sequence
  Description of Artificial Sequence: Synthetic oligonucleotide
  Target: ANGPTL3; (-) strand; PAM type: YTN; PAM sequence: CTG
aacccctgttttctcatctc

SEQ ID NO: 10793 - DNA, 20 bp, Artificial Sequence
  Description of Artificial Sequence: Synthetic oligonucleotide
  Target: ANGPTL3; (-) strand; PAM type: YTN; PAM sequence: CTC
tgaacccctgttttctcatc

SEQ ID NO: 10794 - DNA, 20 bp, Artificial Sequence
  Description of Artificial Sequence: Synthetic oligonucleotide
  Target: ANGPTL3; (-) strand; PAM type: YTN; PAM sequence: TTC
acatctctgaacccctgttt

SEQ ID NO: 10795 - DNA, 20 bp, Artificial Sequence
  Description of Artificial Sequence: Synthetic oligonucleotide
  Target: ANGPTL3; (-) strand; PAM type: YTN; PAM sequence: CTT
cacatctctgaacccctgtt

SEQ ID NO: 10796 - DNA, 20 bp, Artificial Sequence
  Description of Artificial Sequence: Synthetic oligonucleotide
  Target: ANGPTL3; (-) strand; PAM type: YTN; PAM sequence: TTA
cttcacatctctgaacccct

SEQ ID NO: 10797 - DNA, 20 bp, Artificial Sequence
  Description of Artificial Sequence: Synthetic oligonucleotide
  Target: ANGPTL3; (-) strand; PAM type: YTN; PAM sequence: TTG
gtcaaattacttcacatctc

SEQ ID NO: 10798 - DNA, 20 bp, Artificial Sequence
  Description of Artificial Sequence: Synthetic oligonucleotide
  Target: ANGPTL3; (-) strand; PAM type: YTN; PAM sequence: TTT
ggtcaaattacttcacatct

SEQ ID NO: 10799 - DNA, 20 bp, Artificial Sequence
  Description of Artificial Sequence: Synthetic oligonucleotide
  Target: ANGPTL3; (-) strand; PAM type: YTN; PAM sequence: CTT
tggtcaaattacttcacatc

SEQ ID NO: 10800 - DNA, 20 bp, Artificial Sequence
  Description of Artificial Sequence: Synthetic oligonucleotide
  Target: ANGPTL3; (-) strand; PAM type: YTN; PAM sequence: TTG
tgacctttggtcaaattact

SEQ ID NO: 10801 - DNA, 20 bp, Artificial Sequence
  Description of Artificial Sequence: Synthetic oligonucleotide
  Target: ANGPTL3; (-) strand; PAM type: YTN; PAM sequence: TTT
gtgacctttggtcaaattac

SEQ ID NO: 10802 - DNA, 20 bp, Artificial Sequence
  Description of Artificial Sequence: Synthetic oligonucleotide
  Target: ANGPTL3; (-) strand; PAM type: YTN; PAM sequence: CTT
tgtgacctttggtcaaatta

SEQ ID NO: 10803 - DNA, 20 bp, Artificial Sequence
  Description of Artificial Sequence: Synthetic oligonucleotide
  Target: ANGPTL3; (-) strand; PAM type: YTN; PAM sequence: TTC
agctttgtgacctttggtca

SEQ ID NO: 10804 - DNA, 20 bp, Artificial Sequence
  Description of Artificial Sequence: Synthetic oligonucleotide
  Target: ANGPTL3; (-) strand; PAM type: YTN; PAM sequence: CTT
cagctttgtgacctttggtc

SEQ ID NO: 10805 - DNA, 20 bp, Artificial Sequence
  Description of Artificial Sequence: Synthetic oligonucleotide
  Target: ANGPTL3; (-) strand; PAM type: YTN; PAM sequence: TTC
ttcagctttgtgacctttgg

SEQ ID NO: 10806 - DNA, 20 bp, Artificial Sequence
  Description of Artificial Sequence: Synthetic oligonucleotide
  Target: ANGPTL3; (-) strand; PAM type: YTN; PAM sequence: TTC
atattcttcagctttgtgac

SEQ ID NO: 10807 - DNA, 20 bp, Artificial Sequence
  Description of Artificial Sequence: Synthetic oligonucleotide
  Target: ANGPTL3; (-) strand; PAM type: YTN; PAM sequence: TTT
catattcttcagctttgtga

SEQ ID NO: 10808 - DNA, 20 bp, Artificial Sequence
  Description of Artificial Sequence: Synthetic oligonucleotide
  Target: ANGPTL3; (-) strand; PAM type: YTN; PAM sequence: CTG
aatcagaatcccggatttca

SEQ ID NO: 10809 - DNA, 20 bp, Artificial Sequence
  Description of Artificial Sequence: Synthetic oligonucleotide
  Target: ANGPTL3; (-) strand; PAM type: YTN; PAM sequence: CTG
cctgaatcagaatcccggat

SEQ ID NO: 10810 - DNA, 20 bp, Artificial Sequence
  Description of Artificial Sequence: Synthetic oligonucleotide
  Target: ANGPTL3; (-) strand; PAM type: YTN; PAM sequence: CTG
gaataagactgcctgaatca

SEQ ID NO: 10811 - DNA, 20 bp, Artificial Sequence
  Description of Artificial Sequence: Synthetic oligonucleotide
  Target: ANGPTL3; (-) strand; PAM type: YTN; PAM sequence: TTC
tggaataagactgcctgaat

SEQ ID NO: 10812 - DNA, 20 bp, Artificial Sequence
  Description of Artificial Sequence: Synthetic oligonucleotide
  Target: ANGPTL3; (-) strand; PAM type: YTN; PAM sequence: TTA
agagcatgattctggaataa

SEQ ID NO: 10813 - DNA, 20 bp, Artificial Sequence
  Description of Artificial Sequence: Synthetic oligonucleotide
  Target: ANGPTL3; (-) strand; PAM type: YTN; PAM sequence: TTC
catagtggttaagagcatga

SEQ ID NO: 10814 - DNA, 20 bp, Artificial Sequence
  Description of Artificial Sequence: Synthetic oligonucleotide
  Target: ANGPTL3; (-) strand; PAM type: YTN; PAM sequence: TTA
cagtagaggcagtattccat

SEQ ID NO: 10815 - DNA, 20 bp, Artificial Sequence
  Description of Artificial Sequence: Synthetic oligonucleotide
  Target: ANGPTL3; (-) strand; PAM type: YTN; PAM sequence: TTG
ggtataatagttacagtaga

SEQ ID NO: 10816 - DNA, 20 bp, Artificial Sequence
  Description of Artificial Sequence: Synthetic oligonucleotide
  Target: ANGPTL3; (-) strand; PAM type: YTN; PAM sequence: TTT
gggtataatagttacagtag

SEQ ID NO: 10817 - DNA, 20 bp, Artificial Sequence
  Description of Artificial Sequence: Synthetic oligonucleotide
  Target: ANGPTL3; (-) strand; PAM type: YTN; PAM sequence: TTT
tgggtataatagttacagta

SEQ ID NO: 10818 - DNA, 20 bp, Artificial Sequence
  Description of Artificial Sequence: Synthetic oligonucleotide
  Target: ANGPTL3; (-) strand; PAM type: YTN; PAM sequence: TTA
agggttttgggtataatagt

SEQ ID NO: 10819 - DNA, 20 bp, Artificial Sequence
  Description of Artificial Sequence: Synthetic oligonucleotide
  Target: ANGPTL3; (-) strand; PAM type: YTN; PAM sequence: TTA
ggattaagggttttgggtat

SEQ ID NO: 10820 - DNA, 20 bp, Artificial Sequence
  Description of Artificial Sequence: Synthetic oligonucleotide
  Target: ANGPTL3; (-) strand; PAM type: YTN; PAM sequence: CTT
aggattaagggttttgggta

SEQ ID NO: 10821 - DNA, 20 bp, Artificial Sequence
  Description of Artificial Sequence: Synthetic oligonucleotide
  Target: ANGPTL3; (-) strand; PAM type: YTN; PAM sequence: TTG
atgacttaggattaagggtt

SEQ ID NO: 10822 - DNA, 20 bp, Artificial Sequence
  Description of Artificial Sequence: Synthetic oligonucleotide
  Target: ANGPTL3; (-) strand; PAM type: YTN; PAM sequence: TTT
gatgacttaggattaagggt

SEQ ID NO: 10823 - DNA, 20 bp, Artificial Sequence
  Description of Artificial Sequence: Synthetic oligonucleotide
  Target: ANGPTL3; (-) strand; PAM type: YTN; PAM sequence: TTT
tgatgacttaggattaaggg

SEQ ID NO: 10824 - DNA, 20 bp, Artificial Sequence
  Description of Artificial Sequence: Synthetic oligonucleotide
  Target: ANGPTL3; (-) strand; PAM type: YTN; PAM sequence: CTT
ttgatgacttaggattaagg

SEQ ID NO: 10825 - DNA, 20 bp, Artificial Sequence
  Description of Artificial Sequence: Synthetic oligonucleotide
  Target: ANGPTL3; (-) strand; PAM type: YTN; PAM sequence: TTC
cttttgatgacttaggatta

SEQ ID NO: 10826 - DNA, 20 bp, Artificial Sequence
  Description of Artificial Sequence: Synthetic oligonucleotide
  Target: ANGPTL3; (-) strand; PAM type: YTN; PAM sequence: CTT
ccttttgatgacttaggatt

SEQ ID NO: 10827 - DNA, 20 bp, Artificial Sequence
  Description of Artificial Sequence: Synthetic oligonucleotide
  Target: ANGPTL3; (-) strand; PAM type: YTN; PAM sequence: CTC
ttccttttgatgacttagga

SEQ ID NO: 10828 - DNA, 20 bp, Artificial Sequence
  Description of Artificial Sequence: Synthetic oligonucleotide
  Target: ANGPTL3; (-) strand; PAM type: YTN; PAM sequence: TTG
tgtaaaatagaggctcttcc

SEQ ID NO: 10829 - DNA, 20 bp, Artificial Sequence
  Description of Artificial Sequence: Synthetic oligonucleotide
  Target: ANGPTL3; (-) strand; PAM type: YTN; PAM sequence: TTC
attgtgtaaaatagaggctc

SEQ ID NO: 10830 - DNA, 20 bp, Artificial Sequence
  Description of Artificial Sequence: Synthetic oligonucleotide
  Target: ANGPTL3; (-) strand; PAM type: YTN; PAM sequence: CTT
cattgtgtaaaatagaggct

SEQ ID NO: 10831 - DNA, 20 bp, Artificial Sequence
  Description of Artificial Sequence: Synthetic oligonucleotide
  Target: ANGPTL3; (-) strand; PAM type: YTN; PAM sequence: CTC
ttcattgtgtaaaatagagg

SEQ ID NO: 10832 - DNA, 20 bp, Artificial Sequence
  Description of Artificial Sequence: Synthetic oligonucleotide
  Target: ANGPTL3; (-) strand; PAM type: YTN; PAM sequence: TTA
gaaatgcctcttcattgtgt

SEQ ID NO: 10833 - DNA, 20 bp, Artificial Sequence
  Description of Artificial Sequence: Synthetic oligonucleotide
  Target: ANGPTL3; (-) strand; PAM type: YTN; PAM sequence: CTT
agaaatgcctcttcattgtg

SEQ ID NO: 10834 - DNA, 20 bp, Artificial Sequence
  Description of Artificial Sequence: Synthetic oligonucleotide
  Target: ANGPTL3; (-) strand; PAM type: YTN; PAM sequence: TTC
ttagaaatgcctcttcattg

SEQ ID NO: 10835 - DNA, 20 bp, Artificial Sequence
  Description of Artificial Sequence: Synthetic oligonucleotide
  Target: ANGPTL3; (-) strand; PAM type: YTN; PAM sequence: CTA
ttcttagaaatgcctcttca

SEQ ID NO: 10836 - DNA, 20 bp, Artificial Sequence
  Description of Artificial Sequence: Synthetic oligonucleotide
  Target: ANGPTL3; (-) strand; PAM type: YTN; PAM sequence: TTC
tattcttagaaatgcctctt

SEQ ID NO: 10837 - DNA, 20 bp, Artificial Sequence
  Description of Artificial Sequence: Synthetic oligonucleotide
  Target: ANGPTL3; (-) strand; PAM type: YTN; PAM sequence: TTT
ctattcttagaaatgcctct

SEQ ID NO: 10838 - DNA, 20 bp, Artificial Sequence
  Description of Artificial Sequence: Synthetic oligonucleotide
  Target: ANGPTL3; (-) strand; PAM type: YTN; PAM sequence: CTA
aatttctattcttagaaatg

SEQ ID NO: 10839 - DNA, 20 bp, Artificial Sequence
  Description of Artificial Sequence: Synthetic oligonucleotide
  Target: ANGPTL3; (-) strand; PAM type: YTN; PAM sequence: CTC
gtccctaaatttctattctt

SEQ ID NO: 10840 - DNA, 20 bp, Artificial Sequence
  Description of Artificial Sequence: Synthetic oligonucleotide
  Target: ANGPTL3; (-) strand; PAM type: YTN; PAM sequence: CTG
tgctcgtccctaaatttcta

SEQ ID NO: 10841 - DNA, 20 bp, Artificial Sequence
  Description of Artificial Sequence: Synthetic oligonucleotide
  Target: ANGPTL3; (-) strand; PAM type: YTN; PAM sequence: TTA
aaggagtaagccactgtgct

SEQ ID NO: 10842 - DNA, 20 bp, Artificial Sequence
  Description of Artificial Sequence: Synthetic oligonucleotide
  Target: ANGPTL3; (-) strand; PAM type: YTN; PAM sequence: CTG
atattaaaggagtaagccac

SEQ ID NO: 10843 - DNA, 20 bp, Artificial Sequence
  Description of Artificial Sequence: Synthetic oligonucleotide
  Target: ANGPTL3; (-) strand; PAM type: YTN; PAM sequence: CTC
aaagtgctgatattaaagga

SEQ ID NO: 10844 - DNA, 20 bp, Artificial Sequence
  Description of Artificial Sequence: Synthetic oligonucleotide
  Target: ANGPTL3; (-) strand; PAM type: YTN; PAM sequence: CTC
tcaaagtgctgatattaaag

SEQ ID NO: 10845 - DNA, 20 bp, Artificial Sequence
  Description of Artificial Sequence: Synthetic oligonucleotide
  Target: ANGPTL3; (-) strand; PAM type: YTN; PAM sequence: CTC
ccatatcagcctctcaaagt

SEQ ID NO: 10846 - DNA, 20 bp, Artificial Sequence
  Description of Artificial Sequence: Synthetic oligonucleotide
  Target: ANGPTL3; (-) strand; PAM type: YTN; PAM sequence: TTC
aagtgaacctcccatatcag

SEQ ID NO: 10847 - DNA, 20 bp, Artificial Sequence
  Description of Artificial Sequence: Synthetic oligonucleotide
  Target: ANGPTL3; (-) strand; PAM type: YTN; PAM sequence: CTT
caagtgaacctcccatatca

SEQ ID NO: 10848 - DNA, 20 bp, Artificial Sequence
  Description of Artificial Sequence: Synthetic oligonucleotide
  Target: ANGPTL3; (-) strand; PAM type: YTN; PAM sequence: CTG
acttcaagtgaacctcccat

SEQ ID NO: 10849 - DNA, 20 bp, Artificial Sequence
  Description of Artificial Sequence: Synthetic oligonucleotide
  Target: ANGPTL3; (-) strand; PAM type: YTN; PAM sequence: CTC
ctgacttcaagtgaacctcc

SEQ ID NO: 10850 - DNA, 20 bp, Artificial Sequence
  Description of Artificial Sequence: Synthetic oligonucleotide
  Target: ANGPTL3; (-) strand; PAM type: YTN; PAM sequence: TTG
aactcctgacttcaagtgaa

SEQ ID NO: 10851 - DNA, 20 bp, Artificial Sequence
  Description of Artificial Sequence: Synthetic oligonucleotide
  Target: ANGPTL3; (-) strand; PAM type: YTN; PAM sequence: CTT
gaactcctgacttcaagtga

SEQ ID NO: 10852 - DNA, 20 bp, Artificial Sequence
  Description of Artificial Sequence: Synthetic oligonucleotide
  Target: ANGPTL3; (-) strand; PAM type: YTN; PAM sequence: CTG
accttgaactcctgacttca

SEQ ID NO: 10853 - DNA, 20 bp, Artificial Sequence
  Description of Artificial Sequence: Synthetic oligonucleotide
  Target: ANGPTL3; (-) strand; PAM type: YTN; PAM sequence: TTG
cccaagctgaccttgaactc

SEQ ID NO: 10854 - DNA, 20 bp, Artificial Sequence
  Description of Artificial Sequence: Synthetic oligonucleotide
  Target: ANGPTL3; (-) strand; PAM type: YTN; PAM sequence: CTA
tgttgcccaagctgaccttg

SEQ ID NO: 10855 - DNA, 20 bp, Artificial Sequence
  Description of Artificial Sequence: Synthetic oligonucleotide
  Target: ANGPTL3; (-) strand; PAM type: YTN; PAM sequence: TTC
actatgttgcccaagctgac

SEQ ID NO: 10856 - DNA, 20 bp, Artificial Sequence
  Description of Artificial Sequence: Synthetic oligonucleotide
  Target: ANGPTL3; (-) strand; PAM type: YTN; PAM sequence: TTT
cactatgttgcccaagctga

SEQ ID NO: 10857 - DNA, 20 bp, Artificial Sequence
  Description of Artificial Sequence: Synthetic oligonucleotide
  Target: ANGPTL3; (-) strand; PAM type: YTN; PAM sequence: CTG
tgtttcactatgttgcccaa

SEQ ID NO: 10858 - DNA, 20 bp, Artificial Sequence
  Description of Artificial Sequence: Synthetic oligonucleotide
  Target: ANGPTL3; (-) strand; PAM type: YTN; PAM sequence: TTG
tagagactgtgtttcactat

SEQ ID NO: 10859 - DNA, 20 bp, Artificial Sequence
  Description of Artificial Sequence: Synthetic oligonucleotide
  Target: ANGPTL3; (-) strand; PAM type: YTN; PAM sequence: TTT
gtagagactgtgtttcacta

SEQ ID NO: 10860 - DNA, 20 bp, Artificial Sequence
  Description of Artificial Sequence: Synthetic oligonucleotide
  Target: ANGPTL3; (-) strand; PAM type: YTN; PAM sequence: TTT
tgtagagactgtgtttcact

SEQ ID NO: 10861 - DNA, 20 bp, Artificial Sequence
  Description of Artificial Sequence: Synthetic oligonucleotide
  Target: ANGPTL3; (-) strand; PAM type: YTN; PAM sequence: TTA
aatattttgtagagactgtg

SEQ ID NO: 10862 - DNA, 20 bp, Artificial Sequence
  Description of Artificial Sequence: Synthetic oligonucleotide
  Target: ANGPTL3; (-) strand; PAM type: YTN; PAM sequence: TTT
aaatattttgtagagactgt

SEQ ID NO: 10863 - DNA, 20 bp, Artificial Sequence
  Description of Artificial Sequence: Synthetic oligonucleotide
  Target: ANGPTL3; (-) strand; PAM type: YTN; PAM sequence: TTT
taaatattttgtagagactg

SEQ ID NO: 10864 - DNA, 20 bp, Artificial Sequence
  Description of Artificial Sequence: Synthetic oligonucleotide
  Target: ANGPTL3; (-) strand; PAM type: YTN; PAM sequence: TTT
ttaaatattttgtagagact

SEQ ID NO: 10865 - DNA, 20 bp, Artificial Sequence
  Description of Artificial Sequence: Synthetic oligonucleotide
  Target: ANGPTL3; (-) strand; PAM type: YTN; PAM sequence: CTA
atttttaaatattttgtaga

SEQ ID NO: 10866 - DNA, 20 bp, Artificial Sequence
  Description of Artificial Sequence: Synthetic oligonucleotide
  Target: ANGPTL3; (-) strand; PAM type: YTN; PAM sequence: CTA
tagatgcatgccaccacacc

SEQ ID NO: 10867 - DNA, 20 bp, Artificial Sequence
  Description of Artificial Sequence: Synthetic oligonucleotide
  Target: ANGPTL3; (-) strand; PAM type: YTN; PAM sequence: CTG
agactatagatgcatgccac

SEQ ID NO: 10868 - DNA, 20 bp, Artificial Sequence
  Description of Artificial Sequence: Synthetic oligonucleotide
  Target: ANGPTL3; (-) strand; PAM type: YTN; PAM sequence: CTC
ccaagtagctgagactatag

SEQ ID NO: 10869 - DNA, 20 bp, Artificial Sequence
  Description of Artificial Sequence: Synthetic oligonucleotide
  Target: ANGPTL3; (-) strand; PAM type: YTN; PAM sequence: CTG
tctcccaagtagctgagact

SEQ ID NO: 10870 - DNA, 20 bp, Artificial Sequence
  Description of Artificial Sequence: Synthetic oligonucleotide
  Target: ANGPTL3; (-) strand; PAM type: YTN; PAM sequence: CTC
tgtctcccaagtagctgaga

SEQ ID NO: 10871 - DNA, 20 bp, Artificial Sequence
  Description of Artificial Sequence: Synthetic oligonucleotide
  Target: ANGPTL3; (-) strand; PAM type: YTN; PAM sequence: CTC
cctctgtctcccaagtagct

SEQ ID NO: 10872 - DNA, 20 bp, Artificial Sequence
  Description of Artificial Sequence: Synthetic oligonucleotide
  Target: ANGPTL3; (-) strand; PAM type: YTN; PAM sequence: CTC
ctccctctgtctcccaagta

SEQ ID NO: 10873 - DNA, 20 bp, Artificial Sequence
  Description of Artificial Sequence: Synthetic oligonucleotide
  Target: ANGPTL3; (-) strand; PAM type: YTN; PAM sequence: CTC
gagcaagcctcctccctctg

SEQ ID NO: 10874 - DNA, 20 bp, Artificial Sequence
  Description of Artificial Sequence: Synthetic oligonucleotide
  Target: ANGPTL3; (-) strand; PAM type: YTN; PAM sequence: CTG
ggctcgagcaagcctcctcc

SEQ ID NO: 10875 - DNA, 20 bp, Artificial Sequence
  Description of Artificial Sequence: Synthetic oligonucleotide
  Target: ANGPTL3; (-) strand; PAM type: YTN; PAM sequence: CTC
ctgggctcgagcaagcctcc

SEQ ID NO: 10876 - DNA, 20 bp, Artificial Sequence
  Description of Artificial Sequence: Synthetic oligonucleotide
  Target: ANGPTL3; (-) strand; PAM type: YTN; PAM sequence: CTA
tagccacgaactcctgggct

SEQ ID NO: 10877 - DNA, 20 bp, Artificial Sequence
  Description of Artificial Sequence: Synthetic oligonucleotide
  Target: ANGPTL3; (-) strand; PAM type: YTN; PAM sequence: CTC
actatagccacgaactcctg

SEQ ID NO: 10878 - DNA, 20 bp, Artificial Sequence
  Description of Artificial Sequence: Synthetic oligonucleotide
  Target: ANGPTL3; (-) strand; PAM type: YTN; PAM sequence: CTG
gagtgcagtggcatgatcat

SEQ ID NO: 10879 - DNA, 20 bp, Artificial Sequence
  Description of Artificial Sequence: Synthetic oligonucleotide
  Target: ANGPTL3; (-) strand; PAM type: YTN; PAM sequence: TTG
tccaggctggagtgcagtgg

SEQ ID NO: 10880 - DNA, 20 bp, Artificial Sequence
  Description of Artificial Sequence: Synthetic oligonucleotide
  Target: ANGPTL3; (-) strand; PAM type: YTN; PAM sequence: CTG
ttgtccaggctggagtgcag

SEQ ID NO: 10881 - DNA, 20 bp, Artificial Sequence
  Description of Artificial Sequence: Synthetic oligonucleotide
  Target: ANGPTL3; (-) strand; PAM type: YTN; PAM sequence: CTC
tgttgtccaggctggagtgc

SEQ ID NO: 10882 - DNA, 20 bp, Artificial Sequence
  Description of Artificial Sequence: Synthetic oligonucleotide
  Target: ANGPTL3; (-) strand; PAM type: YTN; PAM sequence: TTG
ctctgttgtccaggctggag

SEQ ID NO: 10883 - DNA, 20 bp, Artificial Sequence
  Description of Artificial Sequence: Synthetic oligonucleotide
  Target: ANGPTL3; (-) strand; PAM type: YTN; PAM sequence: CTT
gctctgttgtccaggctgga

SEQ ID NO: 10884 - DNA, 20 bp, Artificial Sequence
  Description of Artificial Sequence: Synthetic oligonucleotide
  Target: ANGPTL3; (-) strand; PAM type: YTN; PAM sequence: TTA
gagacagggtcttgctctgt

SEQ ID NO: 10885 - DNA, 20 bp, Artificial Sequence
  Description of Artificial Sequence: Synthetic oligonucleotide
  Target: ANGPTL3; (-) strand; PAM type: YTN; PAM sequence: TTT
agagacagggtcttgctctg

SEQ ID NO: 10886 - DNA, 20 bp, Artificial Sequence
  Description of Artificial Sequence: Synthetic oligonucleotide
  Target: ANGPTL3; (-) strand; PAM type: YTN; PAM sequence: TTT
tagagacagggtcttgctct

SEQ ID NO: 10887 - DNA, 20 bp, Artificial Sequence
  Description of Artificial Sequence: Synthetic oligonucleotide
  Target: ANGPTL3; (-) strand; PAM type: YTN; PAM sequence: TTT
ttagagacagggtcttgctc

SEQ ID NO: 10888 - DNA, 20 bp, Artificial Sequence
  Description of Artificial Sequence: Synthetic oligonucleotide
  Target: ANGPTL3; (-) strand; PAM type: YTN; PAM sequence: TTT
tttagagacagggtcttgct

SEQ ID NO: 10889 - DNA, 20 bp, Artificial Sequence
  Description of Artificial Sequence: Synthetic oligonucleotide
  Target: ANGPTL3; (-) strand; PAM type: YTN; PAM sequence: CTT
ttttagagacagggtcttgc

SEQ ID NO: 10890 - DNA, 20 bp, Artificial Sequence
  Description of Artificial Sequence: Synthetic oligonucleotide
  Target: ANGPTL3; (-) strand; PAM type: YTN; PAM sequence: TTC
ttttttagagacagggtctt

SEQ ID NO: 10891 - DNA, 20 bp, Artificial Sequence
  Description of Artificial Sequence: Synthetic oligonucleotide
  Target: ANGPTL3; (-) strand; PAM type: YTN; PAM sequence: TTT
cttttttagagacagggtct

SEQ ID NO: 10892 - DNA, 20 bp, Artificial Sequence
  Description of Artificial Sequence: Synthetic oligonucleotide
  Target: ANGPTL3; (-) strand; PAM type: YTN; PAM sequence: TTT
tcttttttagagacagggtc

SEQ ID NO: 10893 - DNA, 20 bp, Artificial Sequence
  Description of Artificial Sequence: Synthetic oligonucleotide
  Target: ANGPTL3; (-) strand; PAM type: YTN; PAM sequence: CTT
ttcttttttagagacagggt

SEQ ID NO: 10894 - DNA, 20 bp, Artificial Sequence
  Description of Artificial Sequence: Synthetic oligonucleotide
  Target: ANGPTL3; (-) strand; PAM type: YTN; PAM sequence: TTC
ttttcttttttagagacagg

SEQ ID NO: 10895 - DNA, 20 bp, Artificial Sequence
  Description of Artificial Sequence: Synthetic oligonucleotide
  Target: ANGPTL3; (-) strand; PAM type: YTN; PAM sequence: TTT
cttttcttttttagagacag

SEQ ID NO: 10896 - DNA, 20 bp, Artificial Sequence
  Description of Artificial Sequence: Synthetic oligonucleotide
  Target: ANGPTL3; (-) strand; PAM type: YTN; PAM sequence: TTC
caaatttcttttctttttta

SEQ ID NO: 10897 - DNA, 20 bp, Artificial Sequence
  Description of Artificial Sequence: Synthetic oligonucleotide
  Target: ANGPTL3; (-) strand; PAM type: YTN; PAM sequence: TTT
ccaaatttcttttctttttt

SEQ ID NO: 10898 - DNA, 20 bp, Artificial Sequence
  Description of Artificial Sequence: Synthetic oligonucleotide
  Target: ANGPTL3; (-) strand; PAM type: YTN; PAM sequence: TTA
atacaaaataaaccatttcc

SEQ ID NO: 10899 - DNA, 20 bp, Artificial Sequence
  Description of Artificial Sequence: Synthetic oligonucleotide
  Target: ANGPTL3; (-) strand; PAM type: YTN; PAM sequence: TTG
ttaatacaaaataaaccatt

SEQ ID NO: 10900 - DNA, 20 bp, Artificial Sequence
  Description of Artificial Sequence: Synthetic oligonucleotide
  Target: ANGPTL3; (-) strand; PAM type: YTN; PAM sequence: TTA
taaattgttaatacaaaata

SEQ ID NO: 10901 - DNA, 20 bp, Artificial Sequence
  Description of Artificial Sequence: Synthetic oligonucleotide
  Target: ANGPTL3; (-) strand; PAM type: YTN; PAM sequence: TTC
agtgtaaattataaattgtt

SEQ ID NO: 10902 - DNA, 20 bp, Artificial Sequence
  Description of Artificial Sequence: Synthetic oligonucleotide
  Target: ANGPTL3; (-) strand; PAM type: YTN; PAM sequence: TTT
cagtgtaaattataaattgt

SEQ ID NO: 10903 - DNA, 20 bp, Artificial Sequence
  Description of Artificial Sequence: Synthetic oligonucleotide
  Target: ANGPTL3; (-) strand; PAM type: YTN; PAM sequence: TTA
tcataataaatttcagtgta

SEQ ID NO: 10904 - DNA, 20 bp, Artificial Sequence
  Description of Artificial Sequence: Synthetic oligonucleotide
  Target: ANGPTL3; (-) strand; PAM type: YTN; PAM sequence: TTT
atcataataaatttcagtgt

SEQ ID NO: 10905 - DNA, 20 bp, Artificial Sequence
  Description of Artificial Sequence: Synthetic oligonucleotide
  Target: ANGPTL3; (-) strand; PAM type: YTN; PAM sequence: TTT
tatcataataaatttcagtg

SEQ ID NO: 10906 - DNA, 20 bp, Artificial Sequence
  Description of Artificial Sequence: Synthetic oligonucleotide
  Target: ANGPTL3; (-) strand; PAM type: YTN; PAM sequence: TTA
acacagggaaaagttttatc

SEQ ID NO: 10907 - DNA, 20 bp, Artificial Sequence
  Description of Artificial Sequence: Synthetic oligonucleotide
  Target: ANGPTL3; (-) strand; PAM type: YTN; PAM sequence: TTT
aacacagggaaaagttttat

SEQ ID NO: 10908 - DNA, 20 bp, Artificial Sequence
  Description of Artificial Sequence: Synthetic oligonucleotide
  Target: ANGPTL3; (-) strand; PAM type: YTN; PAM sequence: TTT
taacacagggaaaagtttta

SEQ ID NO: 10909 - DNA, 20 bp, Artificial Sequence
  Description of Artificial Sequence: Synthetic oligonucleotide
  Target: ANGPTL3; (-) strand; PAM type: YTN; PAM sequence: TTT
ttaacacagggaaaagtttt

SEQ ID NO: 10910 - DNA, 20 bp, Artificial Sequence
  Description of Artificial Sequence: Synthetic oligonucleotide
  Target: ANGPTL3; (-) strand; PAM type: YTN; PAM sequence: CTT
tttaacacagggaaaagttt

SEQ ID NO: 10911 - DNA, 20 bp, Artificial Sequence
  Description of Artificial Sequence: Synthetic oligonucleotide
  Target: ANGPTL3; (-) strand; PAM type: YTN; PAM sequence: TTA
atagctttttaacacaggga

SEQ ID NO: 10912 - DNA, 20 bp, Artificial Sequence
  Description of Artificial Sequence: Synthetic oligonucleotide
  Target: ANGPTL3; (-) strand; PAM type: YTN; PAM sequence: TTC
ataaagttaatagcttttta

SEQ ID NO: 10913 - DNA, 20 bp, Artificial Sequence
  Description of Artificial Sequence: Synthetic oligonucleotide
  Target: ANGPTL3; (-) strand; PAM type: YTN; PAM sequence: TTT
cataaagttaatagcttttt

SEQ ID NO: 10914 - DNA, 20 bp, Artificial Sequence
  Description of Artificial Sequence: Synthetic oligonucleotide
  Target: ANGPTL3; (-) strand; PAM type: YTN; PAM sequence: TTT
tcataaagttaatagctttt

SEQ ID NO: 10915 - DNA, 20 bp, Artificial Sequence
  Description of Artificial Sequence: Synthetic oligonucleotide
  Target: ANGPTL3; (-) strand; PAM type: YTN; PAM sequence: TTT
ttcataaagttaatagcttt

SEQ ID NO: 10916 - DNA, 20 bp, Artificial Sequence
  Description of Artificial Sequence: Synthetic oligonucleotide
  Target: ANGPTL3; (-) strand; PAM type: YTN; PAM sequence: CTA
aaagaaatttttcataaagt

SEQ ID NO: 10917 - DNA, 20 bp, Artificial Sequence
  Description of Artificial Sequence: Synthetic oligonucleotide
  Target: ANGPTL3; (-) strand; PAM type: YTN; PAM sequence: TTA
cctaaaagaaatttttcata

SEQ ID NO: 10918 - DNA, 20 bp, Artificial Sequence
  Description of Artificial Sequence: Synthetic oligonucleotide
  Target: ANGPTL3; (-) strand; PAM type: YTN; PAM sequence: CTT
acctaaaagaaatttttcat

SEQ ID NO: 10919 - DNA, 20 bp, Artificial Sequence
  Description of Artificial Sequence: Synthetic oligonucleotide
  Target: ANGPTL3; (-) strand; PAM type: YTN; PAM sequence: CTG
tgtatgtgtgtgggtatata

SEQ ID NO: 10920 - DNA, 20 bp, Artificial Sequence
  Description of Artificial Sequence: Synthetic oligonucleotide
  Target: ANGPTL3; (-) strand; PAM type: YTN; PAM sequence: TTA
acctgtgtatgtgtgtgggt

SEQ ID NO: 10921 - DNA, 20 bp, Artificial Sequence
  Description of Artificial Sequence: Synthetic oligonucleotide
  Target: ANGPTL3; (-) strand; PAM type: YTN; PAM sequence: TTT
aacctgtgtatgtgtgtggg

SEQ ID NO: 10922 - DNA, 20 bp, Artificial Sequence
  Description of Artificial Sequence: Synthetic oligonucleotide
  Target: ANGPTL3; (-) strand; PAM type: YTN; PAM sequence: TTT
taacctgtgtatgtgtgtgg

SEQ ID NO: 10923 - DNA, 20 bp, Artificial Sequence
  Description of Artificial Sequence: Synthetic oligonucleotide
  Target: ANGPTL3; (-) strand; PAM type: YTN; PAM sequence: CTT
ttaacctgtgtatgtgtgtg

SEQ ID NO: 10924 - DNA, 20 bp, Artificial Sequence
  Description of Artificial Sequence: Synthetic oligonucleotide
  Target: ANGPTL3; (-) strand; PAM type: YTN; PAM sequence: CTA
acttttaacctgtgtatgtg

SEQ ID NO: 10925 - DNA, 20 bp, Artificial Sequence
  Description of Artificial Sequence: Synthetic oligonucleotide
  Target: ANGPTL3; (-) strand; PAM type: YTN; PAM sequence: TTA
tgtcacatgaaactaacttt

SEQ ID NO: 10926 - DNA, 20 bp, Artificial Sequence
  Description of Artificial Sequence: Synthetic oligonucleotide
  Target: ANGPTL3; (-) strand; PAM type: YTN; PAM sequence: TTA
ttatgtcacatgaaactaac

SEQ ID NO: 10927 - DNA, 20 bp, Artificial Sequence
  Description of Artificial Sequence: Synthetic oligonucleotide
  Target: ANGPTL3; (-) strand; PAM type: YTN; PAM sequence: CTA
gttattatgtcacatgaaac

SEQ ID NO: 10928 - DNA, 20 bp, Artificial Sequence
  Description of Artificial Sequence: Synthetic oligonucleotide
  Target: ANGPTL3; (-) strand; PAM type: YTN; PAM sequence: CTC
aaaatgctagttattatgtc

SEQ ID NO: 10929 - DNA, 20 bp, Artificial Sequence
  Description of Artificial Sequence: Synthetic oligonucleotide
  Target: ANGPTL3; (-) strand; PAM type: YTN; PAM sequence: CTG
ggcaaacaggtagtgctcaa

SEQ ID NO: 10930 - DNA, 20 bp, Artificial Sequence
  Description of Artificial Sequence: Synthetic oligonucleotide
  Target: ANGPTL3; (-) strand; PAM type: YTN; PAM sequence: TTA
gaacagtgctgggcaaacag

SEQ ID NO: 10931 - DNA, 20 bp, Artificial Sequence
  Description of Artificial Sequence: Synthetic oligonucleotide
  Target: ANGPTL3; (-) strand; PAM type: YTN; PAM sequence: CTT
agaacagtgctgggcaaaca

SEQ ID NO: 10932 - DNA, 20 bp, Artificial Sequence
  Description of Artificial Sequence: Synthetic oligonucleotide
  Target: ANGPTL3; (-) strand; PAM type: YTN; PAM sequence: TTA
acaataatacatgtagagca

SEQ ID NO: 10933 - DNA, 20 bp, Artificial Sequence
  Description of Artificial Sequence: Synthetic oligonucleotide
  Target: ANGPTL3; (-) strand; PAM type: YTN; PAM sequence: TTT
aacaataatacatgtagagc

SEQ ID NO: 10934 - DNA, 20 bp, Artificial Sequence
  Description of Artificial Sequence: Synthetic oligonucleotide
  Target: ANGPTL3; (-) strand; PAM type: YTN; PAM sequence: TTA
tgataatttaacaataatac

SEQ ID NO: 10935 - DNA, 20 bp, Artificial Sequence
  Description of Artificial Sequence: Synthetic oligonucleotide
  Target: ANGPTL3; (-) strand; PAM type: YTN; PAM sequence: TTC
atagtgttatgataatttaa

SEQ ID NO: 10936 - DNA, 20 bp, Artificial Sequence
  Description of Artificial Sequence: Synthetic oligonucleotide
  Target: ANGPTL3; (-) strand; PAM type: YTN; PAM sequence: TTA
tagtacataattcatagtgt

SEQ ID NO: 10937 - DNA, 20 bp, Artificial Sequence
  Description of Artificial Sequence: Synthetic oligonucleotide
  Target: ANGPTL3; (-) strand; PAM type: YTN; PAM sequence: CTG
gggtaattatagtacataat

SEQ ID NO: 10938 - DNA, 20 bp, Artificial Sequence
  Description of Artificial Sequence: Synthetic oligonucleotide
  Target: ANGPTL3; (-) strand; PAM type: YTN; PAM sequence: CTG
taaagctggggtaattatag

SEQ ID NO: 10939 - DNA, 20 bp, Artificial Sequence
  Description of Artificial Sequence: Synthetic oligonucleotide
  Target: ANGPTL3; (-) strand; PAM type: YTN; PAM sequence: CTC
atctgtaaagctggggtaat

SEQ ID NO: 10940 - DNA, 20 bp, Artificial Sequence
  Description of Artificial Sequence: Synthetic oligonucleotide
  Target: ANGPTL3; (-) strand; PAM type: YTN; PAM sequence: CTC
ctcatctgtaaagctggggt

SEQ ID NO: 10941 - DNA, 20 bp, Artificial Sequence
  Description of Artificial Sequence: Synthetic oligonucleotide
  Target: ANGPTL3; (-) strand; PAM type: YTN; PAM sequence: TTA
gtctcctcatctgtaaagct

SEQ ID NO: 10942 - DNA, 20 bp, Artificial Sequence
  Description of Artificial Sequence: Synthetic oligonucleotide
  Target: ANGPTL3; (-) strand; PAM type: YTN; PAM sequence: CTC
cccatggattagtctcctca

SEQ ID NO: 10943 - DNA, 20 bp, Artificial Sequence
  Description of Artificial Sequence: Synthetic oligonucleotide
  Target: ANGPTL3; (-) strand; PAM type: YTN; PAM sequence: TTA
acctccccatggattagtct

SEQ ID NO: 10944 - DNA, 20 bp, Artificial Sequence
  Description of Artificial Sequence: Synthetic oligonucleotide
  Target: ANGPTL3; (-) strand; PAM type: YTN; PAM sequence: CTT
aacctccccatggattagtc

SEQ ID NO: 10945 - DNA, 20 bp, Artificial Sequence
  Description of Artificial Sequence: Synthetic oligonucleotide
  Target: ANGPTL3; (-) strand; PAM type: YTN; PAM sequence: TTA
cttaacctccccatggatta

SEQ ID NO: 10946 - DNA, 20 bp, Artificial Sequence
  Description of Artificial Sequence: Synthetic oligonucleotide
  Target: ANGPTL3; (-) strand; PAM type: YTN; PAM sequence: TTG
gacaagttacttaacctccc

SEQ ID NO: 10947 - DNA, 20 bp, Artificial Sequence
  Description of Artificial Sequence: Synthetic oligonucleotide
  Target: ANGPTL3; (-) strand; PAM type: YTN; PAM sequence: CTT
ggacaagttacttaacctcc

SEQ ID NO: 10948 - DNA, 20 bp, Artificial Sequence
  Description of Artificial Sequence: Synthetic oligonucleotide
  Target: ANGPTL3; (-) strand; PAM type: YTN; PAM sequence: CTG
gccttggacaagttacttaa

SEQ ID NO: 10949 - DNA, 20 bp, Artificial Sequence
  Description of Artificial Sequence: Synthetic oligonucleotide
  Target: ANGPTL3; (-) strand; PAM type: YTN; PAM sequence: CTG
tctggccttggacaagttac

SEQ ID NO: 10950 - DNA, 20 bp, Artificial Sequence
  Description of Artificial Sequence: Synthetic oligonucleotide
  Target: ANGPTL3; (-) strand; PAM type: YTN; PAM sequence: CTA
gctgtctggccttggacaag

SEQ ID NO: 10951 - DNA, 20 bp, Artificial Sequence
  Description of Artificial Sequence: Synthetic oligonucleotide
  Target: ANGPTL3; (-) strand; PAM type: YTN; PAM sequence: CTC
tagctgtctggccttggaca

SEQ ID NO: 10952 - DNA, 20 bp, Artificial Sequence
  Description of Artificial Sequence: Synthetic oligonucleotide
  Target: ANGPTL3; (-) strand; PAM type: YTN; PAM sequence: CTG
tggtgtgggtccaaaagccg

SEQ ID NO: 10953 - DNA, 20 bp, Artificial Sequence
  Description of Artificial Sequence: Synthetic oligonucleotide
  Target: ANGPTL3; (-) strand; PAM type: YTN; PAM sequence: CTG
gagtcagactgtggtgtggg

SEQ ID NO: 10954 - DNA, 20 bp, Artificial Sequence
  Description of Artificial Sequence: Synthetic oligonucleotide
  Target: ANGPTL3; (-) strand; PAM type: YTN; PAM sequence: TTA
agaatatgggtgctggagtc

SEQ ID NO: 10955 - DNA, 20 bp, Artificial Sequence
  Description of Artificial Sequence: Synthetic oligonucleotide
  Target: ANGPTL3; (-) strand; PAM type: YTN; PAM sequence: TTG
ttaagaatatgggtgctgga

SEQ ID NO: 10956 - DNA, 20 bp, Artificial Sequence
  Description of Artificial Sequence: Synthetic oligonucleotide
  Target: ANGPTL3; (-) strand; PAM type: YTN; PAM sequence: TTA
atatggtgaaattgttaaga

SEQ ID NO: 10957 - DNA, 20 bp, Artificial Sequence
  Description of Artificial Sequence: Synthetic oligonucleotide
  Target: ANGPTL3; (-) strand; PAM type: YTN; PAM sequence: TTG
acatattaatatggtgaaat

SEQ ID NO: 10958 - DNA, 20 bp, Artificial Sequence
  Description of Artificial Sequence: Synthetic oligonucleotide
  Target: ANGPTL3; (-) strand; PAM type: YTN; PAM sequence: CTT
gacatattaatatggtgaaa

SEQ ID NO: 10959 - DNA, 20 bp, Artificial Sequence
  Description of Artificial Sequence: Synthetic oligonucleotide
  Target: ANGPTL3; (-) strand; PAM type: YTN; PAM sequence: TTA
atcttgacatattaatatgg

SEQ ID NO: 10960 - DNA, 20 bp, Artificial Sequence
  Description of Artificial Sequence: Synthetic oligonucleotide
  Target: ANGPTL3; (-) strand; PAM type: YTN; PAM sequence: CTT
aatcttgacatattaatatg

SEQ ID NO: 10961 - DNA, 20 bp, Artificial Sequence
  Description of Artificial Sequence: Synthetic oligonucleotide
  Target: ANGPTL3; (-) strand; PAM type: YTN; PAM sequence: CTG
cttaatcttgacatattaat

SEQ ID NO: 10962 - DNA, 20 bp, Artificial Sequence
  Description of Artificial Sequence: Synthetic oligonucleotide
  Target: ANGPTL3; (-) strand; PAM type: YTN; PAM sequence: TTA
aaactgcttaatcttgacat

SEQ ID NO: 10963 - DNA, 20 bp, Artificial Sequence
  Description of Artificial Sequence: Synthetic oligonucleotide
  Target: ANGPTL3; (-) strand; PAM type: YTN; PAM sequence: TTT
aaaactgcttaatcttgaca

SEQ ID NO: 10964 - DNA, 20 bp, Artificial Sequence
  Description of Artificial Sequence: Synthetic oligonucleotide
  Target: ANGPTL3; (-) strand; PAM type: YTN; PAM sequence: CTT
taaaactgcttaatcttgac

SEQ ID NO: 10965 - DNA, 20 bp, Artificial Sequence
  Description of Artificial Sequence: Synthetic oligonucleotide
  Target: ANGPTL3; (-) strand; PAM type: YTN; PAM sequence: TTG
tgagaaaatagcatccttta

SEQ ID NO: 10966 - DNA, 20 bp, Artificial Sequence
  Description of Artificial Sequence: Synthetic oligonucleotide
  Target: ANGPTL3; (-) strand; PAM type: YTN; PAM sequence: TTT
gtgagaaaatagcatccttt

SEQ ID NO: 10967 - DNA, 20 bp, Artificial Sequence
  Description of Artificial Sequence: Synthetic oligonucleotide
  Target: ANGPTL3; (-) strand; PAM type: YTN; PAM sequence: TTA
agaaatttgtgagaaaatag

SEQ ID NO: 10968 - DNA, 20 bp, Artificial Sequence
  Description of Artificial Sequence: Synthetic oligonucleotide
  Target: ANGPTL3; (-) strand; PAM type: YTN; PAM sequence: TTC
atattaagaaatttgtgaga

SEQ ID NO: 10969 - DNA, 20 bp, Artificial Sequence
  Description of Artificial Sequence: Synthetic oligonucleotide
  Target: ANGPTL3; (-) strand; PAM type: YTN; PAM sequence: TTG
agtgttcatattaagaaatt

SEQ ID NO: 10970 - DNA, 20 bp, Artificial Sequence
  Description of Artificial Sequence: Synthetic oligonucleotide
  Target: ANGPTL3; (-) strand; PAM type: YTN; PAM sequence: TTA
ttgagtgttcatattaagaa

SEQ ID NO: 10971 - DNA, 20 bp, Artificial Sequence
  Description of Artificial Sequence: Synthetic oligonucleotide
  Target: ANGPTL3; (-) strand; PAM type: YTN; PAM sequence: CTT
attgagtgttcatattaaga

SEQ ID NO: 10972 - DNA, 20 bp, Artificial Sequence
  Description of Artificial Sequence: Synthetic oligonucleotide
  Target: ANGPTL3; (-) strand; PAM type: YTN; PAM sequence: TTC
ttattgagtgttcatattaa

SEQ ID NO: 10973 - DNA, 20 bp, Artificial Sequence
  Description of Artificial Sequence: Synthetic oligonucleotide
  Target: ANGPTL3; (-) strand; PAM type: YTN; PAM sequence: TTA
ttcttattgagtgttcatat

SEQ ID NO: 10974 - DNA, 20 bp, Artificial Sequence
  Description of Artificial Sequence: Synthetic oligonucleotide
  Target: ANGPTL3; (-) strand; PAM type: YTN; PAM sequence: TTA
gtgattattcttattgagtg

SEQ ID NO: 10975 - DNA, 20 bp, Artificial Sequence
  Description of Artificial Sequence: Synthetic oligonucleotide
  Target: ANGPTL3; (-) strand; PAM type: YTN; PAM sequence: TTA
tattagtgattattcttatt

SEQ ID NO: 10976 - DNA, 20 bp, Artificial Sequence
  Description of Artificial Sequence: Synthetic oligonucleotide
  Target: ANGPTL3; (-) strand; PAM type: YTN; PAM sequence: CTT
atattagtgattattcttat

SEQ ID NO: 10977 - DNA, 20 bp, Artificial Sequence
  Description of Artificial Sequence: Synthetic oligonucleotide
  Target: ANGPTL3; (-) strand; PAM type: YTN; PAM sequence: CTA
aatgcttatattagtgatta

SEQ ID NO: 10978 - DNA, 20 bp, Artificial Sequence
  Description of Artificial Sequence: Synthetic oligonucleotide
  Target: ANGPTL3; (-) strand; PAM type: YTN; PAM sequence: TTA
aaaaaatactaaatgcttat

SEQ ID NO: 10979 - DNA, 20 bp, Artificial Sequence
  Description of Artificial Sequence: Synthetic oligonucleotide
  Target: ANGPTL3; (-) strand; PAM type: YTN; PAM sequence: TTA
gtgttaaaaaaatactaaat

SEQ ID NO: 10980 - DNA, 20 bp, Artificial Sequence
  Description of Artificial Sequence: Synthetic oligonucleotide
  Target: ANGPTL3; (-) strand; PAM type: YTN; PAM sequence: CTT
agtgttaaaaaaatactaaa

SEQ ID NO: 10981 - DNA, 20 bp, Artificial Sequence
  Description of Artificial Sequence: Synthetic oligonucleotide
  Target: ANGPTL3; (-) strand; PAM type: YTN; PAM sequence: TTC
caacttagtgttaaaaaaat

SEQ ID NO: 10982 - DNA, 20 bp, Artificial Sequence
  Description of Artificial Sequence: Synthetic oligonucleotide
  Target: ANGPTL3; (-) strand; PAM type: YTN; PAM sequence: CTT
ccaacttagtgttaaaaaaa

SEQ ID NO: 10983 - DNA, 20 bp, Artificial Sequence
  Description of Artificial Sequence: Synthetic oligonucleotide
  Target: ANGPTL3; (-) strand; PAM type: YTN; PAM sequence: CTA
tgcttccaacttagtgttaa

SEQ ID NO: 10984 - DNA, 20 bp, Artificial Sequence
  Description of Artificial Sequence: Synthetic oligonucleotide
  Target: ANGPTL3; (-) strand; PAM type: YTN; PAM sequence: TTC
cactatgcttccaacttagt

SEQ ID NO: 10985 - DNA, 20 bp, Artificial Sequence
  Description of Artificial Sequence: Synthetic oligonucleotide
  Target: ANGPTL3; (-) strand; PAM type: YTN; PAM sequence: CTA
aaaataaatgttccactatg

SEQ ID NO: 10986 - DNA, 20 bp, Artificial Sequence
  Description of Artificial Sequence: Synthetic oligonucleotide
  Target: ANGPTL3; (-) strand; PAM type: YTN; PAM sequence: TTC
taaaaataaatgttccacta

SEQ ID NO: 10987 - DNA, 20 bp, Artificial Sequence
  Description of Artificial Sequence: Synthetic oligonucleotide
  Target: ANGPTL3; (-) strand; PAM type: YTN; PAM sequence: TTT
ctaaaaataaatgttccact

SEQ ID NO: 10988 - DNA, 20 bp, Artificial Sequence
  Description of Artificial Sequence: Synthetic oligonucleotide
  Target: ANGPTL3; (-) strand; PAM type: YTN; PAM sequence: TTA
ataatatttctaaaaataaa

SEQ ID NO: 10989 - DNA, 20 bp, Artificial Sequence
  Description of Artificial Sequence: Synthetic oligonucleotide
  Target: ANGPTL3; (-) strand; PAM type: YTN; PAM sequence: TTA
caagcgtgagcccagccaat

SEQ ID NO: 10990 - DNA, 20 bp, Artificial Sequence
  Description of Artificial Sequence: Synthetic oligonucleotide
  Target: ANGPTL3; (-) strand; PAM type: YTN; PAM sequence: TTA
caggcatgagcccagccgat

SEQ ID NO: 10991 - DNA, 20 bp, Artificial Sequence
  Description of Artificial Sequence: Synthetic oligonucleotide
  Target: ANGPTL3; (-) strand; PAM type: YTN; PAM sequence: TTT
acaggcatgagcccagccga

SEQ ID NO: 10992 - DNA, 20 bp, Artificial Sequence
  Description of Artificial Sequence: Synthetic oligonucleotide
  Target: ANGPTL3; (-) strand; PAM type: YTN; PAM sequence: CTC
ccaaaatttacaggcatgag

SEQ ID NO: 10993 - DNA, 20 bp, Artificial Sequence
  Description of Artificial Sequence: Synthetic oligonucleotide
  Target: ANGPTL3; (-) strand; PAM type: YTN; PAM sequence: TTG
gcctcccaaaatttacaggc

SEQ ID NO: 10994 - DNA, 20 bp, Artificial Sequence
  Description of Artificial Sequence: Synthetic oligonucleotide
  Target: ANGPTL3; (-) strand; PAM type: YTN; PAM sequence: CTT
ggcctcccaaaatttacagg

SEQ ID NO: 10995 - DNA, 20 bp, Artificial Sequence
  Description of Artificial Sequence: Synthetic oligonucleotide
  Target: ANGPTL3; (-) strand; PAM type: YTN; PAM sequence: TTA
ccttggcctcccaaaattta

SEQ ID NO: 10996 - DNA, 20 bp, Artificial Sequence
  Description of Artificial Sequence: Synthetic oligonucleotide
  Target: ANGPTL3; (-) strand; PAM type: YTN; PAM sequence: TTT
accttggcctcccaaaattt

SEQ ID NO: 10997 - DNA, 20 bp, Artificial Sequence
  Description of Artificial Sequence: Synthetic oligonucleotide
  Target: ANGPTL3; (-) strand; PAM type: YTN; PAM sequence: TTT
taccttggcctcccaaaatt

SEQ ID NO: 10998 - DNA, 20 bp, Artificial Sequence
  Description of Artificial Sequence: Synthetic oligonucleotide
  Target: ANGPTL3; (-) strand; PAM type: YTN; PAM sequence: CTT
ttaccttggcctcccaaaat

SEQ ID NO: 10999 - DNA, 20 bp, Artificial Sequence
  Description of Artificial Sequence: Synthetic oligonucleotide
  Target: ANGPTL3; (-) strand; PAM type: YTN; PAM sequence: TTC
ttttaccttggcctcccaaa

SEQ ID NO: 11000 - DNA, 20 bp, Artificial Sequence
  Description of Artificial Sequence: Synthetic oligonucleotide
  Target: ANGPTL3; (-) strand; PAM type: YTN; PAM sequence: CTC
aagcaattcttttaccttgg

SEQ ID NO: 11001 - DNA, 20 bp, Artificial Sequence
  Description of Artificial Sequence: Synthetic oligonucleotide
  Target: ANGPTL3; (-) strand; PAM type: YTN; PAM sequence: CTG
ggctcaagcaattcttttac

SEQ ID NO: 11002 - DNA, 20 bp, Artificial Sequence
  Description of Artificial Sequence: Synthetic oligonucleotide
  Target: ANGPTL3; (-) strand; PAM type: YTN; PAM sequence: CTG
gaaatactgggctcaagcaa

SEQ ID NO: 11003 - DNA, 20 bp, Artificial Sequence
  Description of Artificial Sequence: Synthetic oligonucleotide
  Target: ANGPTL3; (-) strand; PAM type: YTN; PAM sequence: CTG
gtctggaaatactgggctca

SEQ ID NO: 11004 - DNA, 20 bp, Artificial Sequence
  Description of Artificial Sequence: Synthetic oligonucleotide
  Target: ANGPTL3; (-) strand; PAM type: YTN; PAM sequence: TTG
cccatgctggtctggaaata

SEQ ID NO: 11005 - DNA, 20 bp, Artificial Sequence
  Description of Artificial Sequence: Synthetic oligonucleotide
  Target: ANGPTL3; (-) strand; PAM type: YTN; PAM sequence: TTA
atgtattgcccatgctggtc

SEQ ID NO: 11006 - DNA, 20 bp, Artificial Sequence
  Description of Artificial Sequence: Synthetic oligonucleotide
  Target: ANGPTL3; (-) strand; PAM type: YTN; PAM sequence: CTT
aatgtattgcccatgctggt

SEQ ID NO: 11007 - DNA, 20 bp, Artificial Sequence
  Description of Artificial Sequence: Synthetic oligonucleotide
  Target: ANGPTL3; (-) strand; PAM type: YTN; PAM sequence: TTA
aagatgatgtcttaatgtat

SEQ ID NO: 11008 - DNA, 20 bp, Artificial Sequence
  Description of Artificial Sequence: Synthetic oligonucleotide
  Target: ANGPTL3; (-) strand; PAM type: YTN; PAM sequence: TTT
aaagatgatgtcttaatgta

SEQ ID NO: 11009 - DNA, 20 bp, Artificial Sequence
  Description of Artificial Sequence: Synthetic oligonucleotide
  Target: ANGPTL3; (-) strand; PAM type: YTN; PAM sequence: TTT
taaagatgatgtcttaatgt

SEQ ID NO: 11010 - DNA, 20 bp, Artificial Sequence
  Description of Artificial Sequence: Synthetic oligonucleotide
  Target: ANGPTL3; (-) strand; PAM type: YTN; PAM sequence: TTT
ttaaagatgatgtcttaatg

SEQ ID NO: 11011 - DNA, 20 bp, Artificial Sequence
  Description of Artificial Sequence: Synthetic oligonucleotide
  Target: ANGPTL3; (-) strand; PAM type: YTN; PAM sequence: TTT
tttaaagatgatgtcttaat

SEQ ID NO: 11012 - DNA, 20 bp, Artificial Sequence
  Description of Artificial Sequence: Synthetic oligonucleotide
  Target: ANGPTL3; (-) strand; PAM type: YTN; PAM sequence: TTT
ttttaaagatgatgtcttaa

SEQ ID NO: 11013 - DNA, 20 bp, Artificial Sequence
  Description of Artificial Sequence: Synthetic oligonucleotide
  Target: ANGPTL3; (-) strand; PAM type: YTN; PAM sequence: TTT
tttttaaagatgatgtctta

SEQ ID NO: 11014 - DNA, 20 bp, Artificial Sequence
  Description of Artificial Sequence: Synthetic oligonucleotide
  Target: ANGPTL3; (-) strand; PAM type: YTN; PAM sequence: TTT
ttttttaaagatgatgtctt

SEQ ID NO: 11015 - DNA, 20 bp, Artificial Sequence
  Description of Artificial Sequence: Synthetic oligonucleotide
  Target: ANGPTL3; (-) strand; PAM type: YTN; PAM sequence: TTT
tttttttaaagatgatgtct

SEQ ID NO: 11016 - DNA, 20 bp, Artificial Sequence
  Description of Artificial Sequence: Synthetic oligonucleotide
  Target: ANGPTL3; (-) strand; PAM type: YTN; PAM sequence: TTA
ataacattttttttttaaag

SEQ ID NO: 11017 - DNA, 20 bp, Artificial Sequence
  Description of Artificial Sequence: Synthetic oligonucleotide
  Target: ANGPTL3; (-) strand; PAM type: YTN; PAM sequence: TTA
acaaaaagaggagattaata

SEQ ID NO: 11018 - DNA, 20 bp, Artificial Sequence
  Description of Artificial Sequence: Synthetic oligonucleotide
  Target: ANGPTL3; (-) strand; PAM type: YTN; PAM sequence: TTT
aacaaaaagaggagattaat

SEQ ID NO: 11019 - DNA, 20 bp, Artificial Sequence
  Description of Artificial Sequence: Synthetic oligonucleotide
  Target: ANGPTL3; (-) strand; PAM type: YTN; PAM sequence: TTG
ataatatacatttaacaaaa

SEQ ID NO: 11020 - DNA, 20 bp, Artificial Sequence
  Description of Artificial Sequence: Synthetic oligonucleotide
  Target: ANGPTL3; (-) strand; PAM type: YTN; PAM sequence: TTT
gataatatacatttaacaaa

SEQ ID NO: 11021 - DNA, 20 bp, Artificial Sequence
  Description of Artificial Sequence: Synthetic oligonucleotide
  Target: ANGPTL3; (-) strand; PAM type: YTN; PAM sequence: TTT
tgataatatacatttaacaa

SEQ ID NO: 11022 - DNA, 20 bp, Artificial Sequence
  Description of Artificial Sequence: Synthetic oligonucleotide
  Target: ANGPTL3; (-) strand; PAM type: YTN; PAM sequence: TTA
gtaacaattttgataatata

SEQ ID NO: 11023 - DNA, 20 bp, Artificial Sequence
  Description of Artificial Sequence: Synthetic oligonucleotide
  Target: ANGPTL3; (-) strand; PAM type: YTN; PAM sequence: CTT
agtaacaattttgataatat

SEQ ID NO: 11024 - DNA, 20 bp, Artificial Sequence
  Description of Artificial Sequence: Synthetic oligonucleotide
  Target: ANGPTL3; (-) strand; PAM type: YTN; PAM sequence: TTA
gcttagtaacaattttgata

SEQ ID NO: 11025 - DNA, 20 bp, Artificial Sequence
  Description of Artificial Sequence: Synthetic oligonucleotide
  Target: ANGPTL3; (-) strand; PAM type: YTN; PAM sequence: TTG
ttagcttagtaacaattttg

SEQ ID NO: 11026 - DNA, 20 bp, Artificial Sequence
  Description of Artificial Sequence: Synthetic oligonucleotide
  Target: ANGPTL3; (-) strand; PAM type: YTN; PAM sequence: TTT
gttagcttagtaacaatttt

SEQ ID NO: 11027 - DNA, 20 bp, Artificial Sequence
  Description of Artificial Sequence: Synthetic oligonucleotide
  Target: ANGPTL3; (-) strand; PAM type: YTN; PAM sequence: CTG
aagtttgttagcttagtaac

SEQ ID NO: 11028 - DNA, 20 bp, Artificial Sequence
  Description of Artificial Sequence: Synthetic oligonucleotide
  Target: ANGPTL3; (-) strand; PAM type: YTN; PAM sequence: TTC
tgaagtttgttagcttagta

SEQ ID NO: 11029 - DNA, 20 bp, Artificial Sequence
  Description of Artificial Sequence: Synthetic oligonucleotide
  Target: ANGPTL3; (-) strand; PAM type: YTN; PAM sequence: TTT
ctgaagtttgttagcttagt

SEQ ID NO: 11030 - DNA, 20 bp, Artificial Sequence
  Description of Artificial Sequence: Synthetic oligonucleotide
  Target: ANGPTL3; (-) strand; PAM type: YTN; PAM sequence: TTT
tctgaagtttgttagcttag

SEQ ID NO: 11031 - DNA, 20 bp, Artificial Sequence
  Description of Artificial Sequence: Synthetic oligonucleotide
  Target: ANGPTL3; (-) strand; PAM type: YTN; PAM sequence: TTT
ttctgaagtttgttagctta

SEQ ID NO: 11032 - DNA, 20 bp, Artificial Sequence
  Description of Artificial Sequence: Synthetic oligonucleotide
  Target: ANGPTL3; (-) strand; PAM type: YTN; PAM sequence: TTG
cccatcataagtttttctga

SEQ ID NO: 11033 - DNA, 20 bp, Artificial Sequence
  Description of Artificial Sequence: Synthetic oligonucleotide
  Target: ANGPTL3; (-) strand; PAM type: YTN; PAM sequence: CTT
gcccatcataagtttttctg

SEQ ID NO: 11034 - DNA, 20 bp, Artificial Sequence
  Description of Artificial Sequence: Synthetic oligonucleotide
  Target: ANGPTL3; (-) strand; PAM type: YTN; PAM sequence: TTC
aatgtcacaagcagcttgcc

SEQ ID NO: 11035 - DNA, 20 bp, Artificial Sequence
  Description of Artificial Sequence: Synthetic oligonucleotide
  Target: ANGPTL3; (-) strand; PAM type: YTN; PAM sequence: CTT
caatgtcacaagcagcttgc

SEQ ID NO: 11036 - DNA, 20 bp, Artificial Sequence
  Description of Artificial Sequence: Synthetic oligonucleotide
  Target: ANGPTL3; (-) strand; PAM type: YTN; PAM sequence: TTA
aataccttcaatgtcacaag

SEQ ID NO: 11037 - DNA, 20 bp, Artificial Sequence
  Description of Artificial Sequence: Synthetic oligonucleotide
  Target: ANGPTL3; (-) strand; PAM type: YTN; PAM sequence: CTT
aaataccttcaatgtcacaa

SEQ ID NO: 11038 - DNA, 20 bp, Artificial Sequence
  Description of Artificial Sequence: Synthetic oligonucleotide
  Target: ANGPTL3; (-) strand; PAM type: YTN; PAM sequence: TTG
aatcttaaataccttcaatg

SEQ ID NO: 11039 - DNA, 20 bp, Artificial Sequence
  Description of Artificial Sequence: Synthetic oligonucleotide
  Target: ANGPTL3; (-) strand; PAM type: YTN; PAM sequence: CTA
gaattgaatcttaaatacct

SEQ ID NO: 11040 - DNA, 20 bp, Artificial Sequence
  Description of Artificial Sequence: Synthetic oligonucleotide
  Target: ANGPTL3; (-) strand; PAM type: YTN; PAM sequence: CTA
ggaccaaactagaattgaat

SEQ ID NO: 11041 - DNA, 20 bp, Artificial Sequence
  Description of Artificial Sequence: Synthetic oligonucleotide
  Target: ANGPTL3; (-) strand; PAM type: YTN; PAM sequence: TTG
aaggaacaatggatatgtgg

SEQ ID NO: 11042 - DNA, 20 bp, Artificial Sequence
  Description of Artificial Sequence: Synthetic oligonucleotide
  Target: ANGPTL3; (-) strand; PAM type: YTN; PAM sequence: CTC
gttgaaggaacaatggatat

SEQ ID NO: 11043 - DNA, 20 bp, Artificial Sequence
  Description of Artificial Sequence: Synthetic oligonucleotide
  Target: ANGPTL3; (-) strand; PAM type: YTN; PAM sequence: TTA
ccatgtgctcgttgaaggaa

SEQ ID NO: 11044 - DNA, 20 bp, Artificial Sequence
  Description of Artificial Sequence: Synthetic oligonucleotide
  Target: ANGPTL3; (-) strand; PAM type: YTN; PAM sequence: TTT
accatgtgctcgttgaagga

SEQ ID NO: 11045 - DNA, 20 bp, Artificial Sequence
  Description of Artificial Sequence: Synthetic oligonucleotide
  Target: ANGPTL3; (-) strand; PAM type: YTN; PAM sequence: CTT
taccatgtgctcgttgaagg

SEQ ID NO: 11046 - DNA, 20 bp, Artificial Sequence
  Description of Artificial Sequence: Synthetic oligonucleotide
  Target: ANGPTL3; (-) strand; PAM type: YTN; PAM sequence: CTC
tttaccatgtgctcgttgaa

SEQ ID NO: 11047 - DNA, 20 bp, Artificial Sequence
  Description of Artificial Sequence: Synthetic oligonucleotide
  Target: ANGPTL3; (-) strand; PAM type: YTN; PAM sequence: CTA
ggctctttaccatgtgctcg

SEQ ID NO: 11048 - DNA, 20 bp, Artificial Sequence
  Description of Artificial Sequence: Synthetic oligonucleotide
  Target: ANGPTL3; (-) strand; PAM type: YTN; PAM sequence: TTC
taggctctttaccatgtgct

SEQ ID NO: 11049 - DNA, 20 bp, Artificial Sequence
  Description of Artificial Sequence: Synthetic oligonucleotide
  Target: ANGPTL3; (-) strand; PAM type: YTN; PAM sequence: CTG
tgttctaggctctttaccat

SEQ ID NO: 11050 - DNA, 20 bp, Artificial Sequence
  Description of Artificial Sequence: Synthetic oligonucleotide
  Target: ANGPTL3; (-) strand; PAM type: YTN; PAM sequence: CTC
tgtgttctaggctctttacc

SEQ ID NO: 11051 - DNA, 20 bp, Artificial Sequence
  Description of Artificial Sequence: Synthetic oligonucleotide
  Target: ANGPTL3; (-) strand; PAM type: YTN; PAM sequence: CTG
tgtctctgtgttctaggctc

SEQ ID NO: 11052 - DNA, 20 bp, Artificial Sequence
  Description of Artificial Sequence: Synthetic oligonucleotide
  Target: ANGPTL3; (-) strand; PAM type: YTN; PAM sequence: TTC
tgtgtctctgtgttctaggc

SEQ ID NO: 11053 - DNA, 20 bp, Artificial Sequence
  Description of Artificial Sequence: Synthetic oligonucleotide
  Target: ANGPTL3; (-) strand; PAM type: YTN; PAM sequence: CTG
tgttctgtgtctctgtgttc

SEQ ID NO: 11054 - DNA, 20 bp, Artificial Sequence
  Description of Artificial Sequence: Synthetic oligonucleotide
  Target: ANGPTL3; (-) strand; PAM type: YTN; PAM sequence: CTC
cactgtgttctgtgtctctg

SEQ ID NO: 11055 - DNA, 20 bp, Artificial Sequence
  Description of Artificial Sequence: Synthetic oligonucleotide
  Target: ANGPTL3; (-) strand; PAM type: YTN; PAM sequence: TTC
tccactgtgttctgtgtctc

SEQ ID NO: 11056 - DNA, 20 bp, Artificial Sequence
  Description of Artificial Sequence: Synthetic oligonucleotide
  Target: ANGPTL3; (-) strand; PAM type: YTN; PAM sequence: TTT
ctccactgtgttctgtgtct

SEQ ID NO: 11057 - DNA, 20 bp, Artificial Sequence
  Description of Artificial Sequence: Synthetic oligonucleotide
  Target: ANGPTL3; (-) strand; PAM type: YTN; PAM sequence: TTT
tctccactgtgttctgtgtc

SEQ ID NO: 11058 - DNA, 20 bp, Artificial Sequence
  Description of Artificial Sequence: Synthetic oligonucleotide
  Target: ANGPTL3; (-) strand; PAM type: YTN; PAM sequence: CTT
ttctccactgtgttctgtgt

SEQ ID NO: 11059 - DNA, 20 bp, Artificial Sequence
  Description of Artificial Sequence: Synthetic oligonucleotide
  Target: ANGPTL3; (-) strand; PAM type: YTN; PAM sequence: CTC
ccttttctccactgtgttct

SEQ ID NO: 11060 - DNA, 20 bp, Artificial Sequence
  Description of Artificial Sequence: Synthetic oligonucleotide
  Target: ANGPTL3; (-) strand; PAM type: YTN; PAM sequence: TTC
actcccttttctccactgtg

SEQ ID NO: 11061 - DNA, 20 bp, Artificial Sequence
  Description of Artificial Sequence: Synthetic oligonucleotide
  Target: ANGPTL3; (-) strand; PAM type: YTN; PAM sequence: TTT
cactcccttttctccactgt

SEQ ID NO: 11062 - DNA, 20 bp, Artificial Sequence
  Description of Artificial Sequence: Synthetic oligonucleotide
  Target: ANGPTL3; (-) strand; PAM type: YTN; PAM sequence: TTA
aagacatttcactccctttt

SEQ ID NO: 11063 - DNA, 20 bp, Artificial Sequence
  Description of Artificial Sequence: Synthetic oligonucleotide
  Target: ANGPTL3; (-) strand; PAM type: YTN; PAM sequence: TTG
tcacaaaatcccatatatag

SEQ ID NO: 11064 - DNA, 20 bp, Artificial Sequence
  Description of Artificial Sequence: Synthetic oligonucleotide
  Target: ANGPTL3; (-) strand; PAM type: YTN; PAM sequence: TTG
tatattgtcacaaaatccca

SEQ ID NO: 11065 - DNA, 20 bp, Artificial Sequence
  Description of Artificial Sequence: Synthetic oligonucleotide
  Target: ANGPTL3; (-) strand; PAM type: YTN; PAM sequence: CTT
gtatattgtcacaaaatccc

SEQ ID NO: 11066 - DNA, 20 bp, Artificial Sequence
  Description of Artificial Sequence: Synthetic oligonucleotide
  Target: ANGPTL3; (-) strand; PAM type: YTN; PAM sequence: TTA
accatccttgtatattgtca

SEQ ID NO: 11067 - DNA, 20 bp, Artificial Sequence
  Description of Artificial Sequence: Synthetic oligonucleotide
  Target: ANGPTL3; (-) strand; PAM type: YTN; PAM sequence: CTT
aaccatccttgtatattgtc

SEQ ID NO: 11068 - DNA, 20 bp, Artificial Sequence
  Description of Artificial Sequence: Synthetic oligonucleotide
  Target: ANGPTL3; (-) strand; PAM type: YTN; PAM sequence: TTA
tatgtcttaaccatccttgt

SEQ ID NO: 11069 - DNA, 20 bp, Artificial Sequence
  Description of Artificial Sequence: Synthetic oligonucleotide
  Target: ANGPTL3; (-) strand; PAM type: YTN; PAM sequence: CTT
atatgtcttaaccatccttg

SEQ ID NO: 11070 - DNA, 20 bp, Artificial Sequence
  Description of Artificial Sequence: Synthetic oligonucleotide
  Target: ANGPTL3; (-) strand; PAM type: YTN; PAM sequence: TTG
catcaccttatatgtcttaa

SEQ ID NO: 11071 - DNA, 20 bp, Artificial Sequence
  Description of Artificial Sequence: Synthetic oligonucleotide
  Target: ANGPTL3; (-) strand; PAM type: YTN; PAM sequence: TTT
gcatcaccttatatgtctta

SEQ ID NO: 11072 - DNA, 20 bp, Artificial Sequence
  Description of Artificial Sequence: Synthetic oligonucleotide
  Target: ANGPTL3; (-) strand; PAM type: YTN; PAM sequence: TTT
tgcatcaccttatatgtctt

SEQ ID NO: 11073 - DNA, 20 bp, Artificial Sequence
  Description of Artificial Sequence: Synthetic oligonucleotide
  Target: ANGPTL3; (-) strand; PAM type: YTN; PAM sequence: TTT
ttgcatcaccttatatgtct

SEQ ID NO: 11074 - DNA, 20 bp, Artificial Sequence
  Description of Artificial Sequence: Synthetic oligonucleotide
  Target: ANGPTL3; (-) strand; PAM type: YTN; PAM sequence: TTT
tttgcatcaccttatatgtc

SEQ ID NO: 11075 - DNA, 20 bp, Artificial Sequence
  Description of Artificial Sequence: Synthetic oligonucleotide
  Target: ANGPTL3; (-) strand; PAM type: YTN; PAM sequence: TTT
ttttgcatcaccttatatgt

SEQ ID NO: 11076 - DNA, 20 bp, Artificial Sequence
  Description of Artificial Sequence: Synthetic oligonucleotide
  Target: ANGPTL3; (-) strand; PAM type: YTN; PAM sequence: TTA
atatgtttttttgcatcacc

SEQ ID NO: 11077 - DNA, 20 bp, Artificial Sequence
  Description of Artificial Sequence: Synthetic oligonucleotide
  Target: ANGPTL3; (-) strand; PAM type: YTN; PAM sequence: TTG
ttaatatgtttttttgcatc

SEQ ID NO: 11078 - DNA, 20 bp, Artificial Sequence
  Description of Artificial Sequence: Synthetic oligonucleotide
  Target: ANGPTL3; (-) strand; PAM type: YTN; PAM sequence: CTA
taattgttaatatgtttttt

SEQ ID NO: 11079 - DNA, 20 bp, Artificial Sequence
  Description of Artificial Sequence: Synthetic oligonucleotide
  Target: ANGPTL3; (-) strand; PAM type: YTN; PAM sequence: TTG
tcactataattgttaatatg

SEQ ID NO: 11080 - DNA, 20 bp, Artificial Sequence
  Description of Artificial Sequence: Synthetic oligonucleotide
  Target: ANGPTL3; (-) strand; PAM type: YTN; PAM sequence: TTT
gtcactataattgttaatat

SEQ ID NO: 11081 - DNA, 20 bp, Artificial Sequence
  Description of Artificial Sequence: Synthetic oligonucleotide
  Target: ANGPTL3; (-) strand; PAM type: YTN; PAM sequence: TTT
tgtcactataattgttaata

SEQ ID NO: 11082 - DNA, 20 bp, Artificial Sequence
  Description of Artificial Sequence: Synthetic oligonucleotide
  Target: ANGPTL3; (-) strand; PAM type: YTN; PAM sequence: TTT
ttgtcactataattgttaat

SEQ ID NO: 11083 - DNA, 20 bp, Artificial Sequence
  Description of Artificial Sequence: Synthetic oligonucleotide
  Target: ANGPTL3; (-) strand; PAM type: YTN; PAM sequence: TTT
tttgtcactataattgttaa

SEQ ID NO: 11084 - DNA, 20 bp, Artificial Sequence
  Description of Artificial Sequence: Synthetic oligonucleotide
  Target: ANGPTL3; (-) strand; PAM type: YTN; PAM sequence: CTC
attttttgtcactataattg

SEQ ID NO: 11085 - DNA, 20 bp, Artificial Sequence
  Description of Artificial Sequence: Synthetic oligonucleotide
  Target: ANGPTL3; (-) strand; PAM type: YTN; PAM sequence: CTC
ctcattttttgtcactataa

SEQ ID NO: 11086 - DNA, 20 bp, Artificial Sequence
  Description of Artificial Sequence: Synthetic oligonucleotide
  Target: ANGPTL3; (-) strand; PAM type: YTN; PAM sequence: TTA
tatgctcctcattttttgtc

SEQ ID NO: 11087 - DNA, 20 bp, Artificial Sequence
  Description of Artificial Sequence: Synthetic oligonucleotide
  Target: ANGPTL3; (-) strand; PAM type: YTN; PAM sequence: CTG
tataaatcaatgtataatta

SEQ ID NO: 11088 - DNA, 20 bp, Artificial Sequence
  Description of Artificial Sequence: Synthetic oligonucleotide
  Target: ANGPTL3; (-) strand; PAM type: YTN; PAM sequence: CTC
tgtataaatcaatgtataat

SEQ ID NO: 11089 - DNA, 20 bp, Artificial Sequence
  Description of Artificial Sequence: Synthetic oligonucleotide
  Target: ANGPTL3; (-) strand; PAM type: YTN; PAM sequence: CTG
gtactctgtataaatcaatg

SEQ ID NO: 11090 - DNA, 20 bp, Artificial Sequence
  Description of Artificial Sequence: Synthetic oligonucleotide
  Target: ANGPTL3; (-) strand; PAM type: YTN; PAM sequence: CTC
tggtactctgtataaatcaa

SEQ ID NO: 11091 - DNA, 20 bp, Artificial Sequence
  Description of Artificial Sequence: Synthetic oligonucleotide
  Target: ANGPTL3; (-) strand; PAM type: YTN; PAM sequence: TTC
ctctggtactctgtataaat

SEQ ID NO: 11092 - DNA, 20 bp, Artificial Sequence
  Description of Artificial Sequence: Synthetic oligonucleotide
  Target: ANGPTL3; (-) strand; PAM type: YTN; PAM sequence: CTG
tgttcctctggtactctgta

SEQ ID NO: 11093 - DNA, 20 bp, Artificial Sequence
  Description of Artificial Sequence: Synthetic oligonucleotide
  Target: ANGPTL3; (-) strand; PAM type: YTN; PAM sequence: CTC
aatgctgtgttcctctggta

SEQ ID NO: 11094 - DNA, 20 bp, Artificial Sequence
  Description of Artificial Sequence: Synthetic oligonucleotide
  Target: ANGPTL3; (-) strand; PAM type: YTN; PAM sequence: CTC
tcaatgctgtgttcctctgg

SEQ ID NO: 11095 - DNA, 20 bp, Artificial Sequence
  Description of Artificial Sequence: Synthetic oligonucleotide
  Target: ANGPTL3; (-) strand; PAM type: YTN; PAM sequence: TTA
cggctctcaatgctgtgttc

SEQ ID NO: 11096 - DNA, 20 bp, Artificial Sequence
  Description of Artificial Sequence: Synthetic oligonucleotide
  Target: ANGPTL3; (-) strand; PAM type: YTN; PAM sequence: CTC
aggtggtgttacggctctca

SEQ ID NO: 11097 - DNA, 20 bp, Artificial Sequence
  Description of Artificial Sequence: Synthetic oligonucleotide
  Target: ANGPTL3; (-) strand; PAM type: YTN; PAM sequence: CTC
cctcaggtggtgttacggct

SEQ ID NO: 11098 - DNA, 20 bp, Artificial Sequence
  Description of Artificial Sequence: Synthetic oligonucleotide
  Target: ANGPTL3; (-) strand; PAM type: YTN; PAM sequence: CTC
cactccctcaggtggtgtta

SEQ ID NO: 11099 - DNA, 20 bp, Artificial Sequence
  Description of Artificial Sequence: Synthetic oligonucleotide
  Target: ANGPTL3; (-) strand; PAM type: YTN; PAM sequence: TTC
tccactccctcaggtggtgt

SEQ ID NO: 11100 - DNA, 20 bp, Artificial Sequence
  Description of Artificial Sequence: Synthetic oligonucleotide
  Target: ANGPTL3; (-) strand; PAM type: YTN; PAM sequence: TTT
ctccactccctcaggtggtg

SEQ ID NO: 11101 - DNA, 20 bp, Artificial Sequence
  Description of Artificial Sequence: Synthetic oligonucleotide
  Target: ANGPTL3; (-) strand; PAM type: YTN; PAM sequence: CTT
tctccactccctcaggtggt

SEQ ID NO: 11102 - DNA, 20 bp, Artificial Sequence
  Description of Artificial Sequence: Synthetic oligonucleotide
  Target: ANGPTL3; (-) strand; PAM type: YTN; PAM sequence: CTG
aagcctttctccactccctc

SEQ ID NO: 11103 - DNA, 20 bp, Artificial Sequence
  Description of Artificial Sequence: Synthetic oligonucleotide
  Target: ANGPTL3; (-) strand; PAM type: YTN; PAM sequence: CTC
tgaagcctttctccactccc

SEQ ID NO: 11104 - DNA, 20 bp, Artificial Sequence
  Description of Artificial Sequence: Synthetic oligonucleotide
  Target: ANGPTL3; (-) strand; PAM type: YTN; PAM sequence: CTC
tctgaagcctttctccactc

SEQ ID NO: 11105 - DNA, 20 bp, Artificial Sequence
  Description of Artificial Sequence: Synthetic oligonucleotide
  Target: ANGPTL3; (-) strand; PAM type: YTN; PAM sequence: TTC
tctctgaagcctttctccac

SEQ ID NO: 11106 - DNA, 20 bp, Artificial Sequence
  Description of Artificial Sequence: Synthetic oligonucleotide
  Target: ANGPTL3; (-) strand; PAM type: YTN; PAM sequence: TTT
ctctctgaagcctttctcca

SEQ ID NO: 11107 - DNA, 20 bp, Artificial Sequence
  Description of Artificial Sequence: Synthetic oligonucleotide
  Target: ANGPTL3; (-) strand; PAM type: YTN; PAM sequence: CTT
tctctctgaagcctttctcc

SEQ ID NO: 11108 - DNA, 20 bp, Artificial Sequence
  Description of Artificial Sequence: Synthetic oligonucleotide
  Target: ANGPTL3; (-) strand; PAM type: YTN; PAM sequence: TTC
caaaaaacactttctctctg

SEQ ID NO: 11109 - DNA, 20 bp, Artificial Sequence
  Description of Artificial Sequence: Synthetic oligonucleotide
  Target: ANGPTL3; (-) strand; PAM type: YTN; PAM sequence: TTG
gaaacagtgatccattccaa

SEQ ID NO: 11110 - DNA, 20 bp, Artificial Sequence
  Description of Artificial Sequence: Synthetic oligonucleotide
  Target: ANGPTL3; (-) strand; PAM type: YTN; PAM sequence: TTT
ggaaacagtgatccattcca

SEQ ID NO: 11111 - DNA, 20 bp, Artificial Sequence
  Description of Artificial Sequence: Synthetic oligonucleotide
  Target: ANGPTL3; (-) strand; PAM type: YTN; PAM sequence: TTT
tggaaacagtgatccattcc

SEQ ID NO: 11112 - DNA, 20 bp, Artificial Sequence
  Description of Artificial Sequence: Synthetic oligonucleotide
  Target: ANGPTL3; (-) strand; PAM type: YTN; PAM sequence: CTT
ttggaaacagtgatccattc

SEQ ID NO: 11113 - DNA, 20 bp, Artificial Sequence
  Description of Artificial Sequence: Synthetic oligonucleotide
  Target: ANGPTL3; (-) strand; PAM type: YTN; PAM sequence: TTC
ttttggaaacagtgatccat

SEQ ID NO: 11114 - DNA, 20 bp, Artificial Sequence
  Description of Artificial Sequence: Synthetic oligonucleotide
  Target: ANGPTL3; (-) strand; PAM type: YTN; PAM sequence: TTA
gttcttttggaaacagtgat

SEQ ID NO: 11115 - DNA, 20 bp, Artificial Sequence
  Description of Artificial Sequence: Synthetic oligonucleotide
  Target: ANGPTL3; (-) strand; PAM type: YTN; PAM sequence: TTT
agttcttttggaaacagtga

SEQ ID NO: 11116 - DNA, 20 bp, Artificial Sequence
  Description of Artificial Sequence: Synthetic oligonucleotide
  Target: ANGPTL3; (-) strand; PAM type: YTN; PAM sequence: CTT
tagttcttttggaaacagtg

SEQ ID NO: 11117 - DNA, 20 bp, Artificial Sequence
  Description of Artificial Sequence: Synthetic oligonucleotide
  Target: ANGPTL3; (-) strand; PAM type: YTN; PAM sequence: CTG
tactttagttcttttggaaa

SEQ ID NO: 11118 - DNA, 20 bp, Artificial Sequence
  Description of Artificial Sequence: Synthetic oligonucleotide
  Target: ANGPTL3; (-) strand; PAM type: YTN; PAM sequence: CTC
aaactgtactttagttcttt

SEQ ID NO: 11119 - DNA, 20 bp, Artificial Sequence
  Description of Artificial Sequence: Synthetic oligonucleotide
  Target: ANGPTL3; (-) strand; PAM type: YTN; PAM sequence: TTC
tcaaactgtactttagttct

SEQ ID NO: 11120 - DNA, 20 bp, Artificial Sequence
  Description of Artificial Sequence: Synthetic oligonucleotide
  Target: ANGPTL3; (-) strand; PAM type: YTN; PAM sequence: TTT
ctcaaactgtactttagttc

SEQ ID NO: 11121 - DNA, 20 bp, Artificial Sequence
  Description of Artificial Sequence: Synthetic oligonucleotide
  Target: ANGPTL3; (-) strand; PAM type: YTN; PAM sequence: TTA
agtatgcatttctcaaactg

SEQ ID NO: 11122 - DNA, 20 bp, Artificial Sequence
  Description of Artificial Sequence: Synthetic oligonucleotide
  Target: ANGPTL3; (-) strand; PAM type: YTN; PAM sequence: TTG
aggggaaaaaagtaatgaat

SEQ ID NO: 11123 - DNA, 20 bp, Artificial Sequence
  Description of Artificial Sequence: Synthetic oligonucleotide
  Target: ANGPTL3; (-) strand; PAM type: YTN; PAM sequence: TTA
aagttgaggggaaaaaagta

SEQ ID NO: 11124 - DNA, 20 bp, Artificial Sequence
  Description of Artificial Sequence: Synthetic oligonucleotide
  Target: ANGPTL3; (-) strand; PAM type: YTN; PAM sequence: TTA
ttaaagttgaggggaaaaaa

SEQ ID NO: 11125 - DNA, 20 bp, Artificial Sequence
  Description of Artificial Sequence: Synthetic oligonucleotide
  Target: ANGPTL3; (-) strand; PAM type: YTN; PAM sequence: TTA
ttattaaagttgaggggaaa

SEQ ID NO: 11126 - DNA, 20 bp, Artificial Sequence
  Description of Artificial Sequence: Synthetic oligonucleotide
  Target: ANGPTL3; (-) strand; PAM type: YTN; PAM sequence: TTT
attattaaagttgaggggaa

SEQ ID NO: 11127 - DNA, 20 bp, Artificial Sequence
  Description of Artificial Sequence: Synthetic oligonucleotide
  Target: ANGPTL3; (-) strand; PAM type: YTN; PAM sequence: TTG
ggtaaatttattattaaagt

SEQ ID NO: 11128 - DNA, 20 bp, Artificial Sequence
  Description of Artificial Sequence: Synthetic oligonucleotide
  Target: ANGPTL3; (-) strand; PAM type: YTN; PAM sequence: TTG
ttgggtaaatttattattaa

SEQ ID NO: 11129 - DNA, 20 bp, Artificial Sequence
  Description of Artificial Sequence: Synthetic oligonucleotide
  Target: ANGPTL3; (-) strand; PAM type: YTN; PAM sequence: TTT
gttgggtaaatttattatta

SEQ ID NO: 11130 - DNA, 20 bp, Artificial Sequence
  Description of Artificial Sequence: Synthetic oligonucleotide
  Target: ANGPTL3; (-) strand; PAM type: YTN; PAM sequence: TTT
tgttgggtaaatttattatt

SEQ ID NO: 11131 - DNA, 20 bp, Artificial Sequence
  Description of Artificial Sequence: Synthetic oligonucleotide
  Target: ANGPTL3; (-) strand; PAM type: YTN; PAM sequence: TTT
ttgttgggtaaatttattat

SEQ ID NO: 11132 - DNA, 20 bp, Artificial Sequence
  Description of Artificial Sequence: Synthetic oligonucleotide
  Target: ANGPTL3; (-) strand; PAM type: YTN; PAM sequence: TTT
tttgttgggtaaatttatta

SEQ ID NO: 11133 - DNA, 20 bp, Artificial Sequence
  Description of Artificial Sequence: Synthetic oligonucleotide
  Target: ANGPTL3; (-) strand; PAM type: YTN; PAM sequence: CTT
ttttgttgggtaaatttatt

SEQ ID NO: 11134 - DNA, 20 bp, Artificial Sequence
  Description of Artificial Sequence: Synthetic oligonucleotide
  Target: ANGPTL3; (-) strand; PAM type: YTN; PAM sequence: TTA
caagtcaaaaataaactttt

SEQ ID NO: 11135 - DNA, 20 bp, Artificial Sequence
  Description of Artificial Sequence: Synthetic oligonucleotide
  Target: ANGPTL3; (-) strand; PAM type: YTN; PAM sequence: TTT
acaagtcaaaaataaacttt

SEQ ID NO: 11136 - DNA, 20 bp, Artificial Sequence
  Description of Artificial Sequence: Synthetic oligonucleotide
  Target: ANGPTL3; (-) strand; PAM type: YTN; PAM sequence: TTA
agagatttacaagtcaaaaa

SEQ ID NO: 11137 - DNA, 20 bp, Artificial Sequence
  Description of Artificial Sequence: Synthetic oligonucleotide
  Target: ANGPTL3; (-) strand; PAM type: YTN; PAM sequence: TTT
aagagatttacaagtcaaaa

SEQ ID NO: 11138 - DNA, 20 bp, Artificial Sequence
  Description of Artificial Sequence: Synthetic oligonucleotide
  Target: ANGPTL3; (-) strand; PAM type: YTN; PAM sequence: TTT
taagagatttacaagtcaaa

SEQ ID NO: 11139 - DNA, 20 bp, Artificial Sequence
  Description of Artificial Sequence: Synthetic oligonucleotide
  Target: ANGPTL3; (-) strand; PAM type: YTN; PAM sequence: TTA
tgattttaagagatttacaa

SEQ ID NO: 11140 - DNA, 20 bp, Artificial Sequence
  Description of Artificial Sequence: Synthetic oligonucleotide
  Target: ANGPTL3; (-) strand; PAM type: YTN; PAM sequence: TTT
atgattttaagagatttaca

SEQ ID NO: 11141 - DNA, 20 bp, Artificial Sequence
  Description of Artificial Sequence: Synthetic oligonucleotide
  Target: ANGPTL3; (-) strand; PAM type: YTN; PAM sequence: TTT
tatgattttaagagatttac

SEQ ID NO: 11142 - DNA, 20 bp, Artificial Sequence
  Description of Artificial Sequence: Synthetic oligonucleotide
  Target: ANGPTL3; (-) strand; PAM type: YTN; PAM sequence: TTT
ttatgattttaagagattta

SEQ ID NO: 11143 - DNA, 20 bp, Artificial Sequence
  Description of Artificial Sequence: Synthetic oligonucleotide
  Target: ANGPTL3; (-) strand; PAM type: YTN; PAM sequence: TTT
tttatgattttaagagattt

SEQ ID NO: 11144 - DNA, 20 bp, Artificial Sequence
  Description of Artificial Sequence: Synthetic oligonucleotide
  Target: ANGPTL3; (-) strand; PAM type: YTN; PAM sequence: CTT
ttttatgattttaagagatt

SEQ ID NO: 11145 - DNA, 20 bp, Artificial Sequence
  Description of Artificial Sequence: Synthetic oligonucleotide
  Target: ANGPTL3; (-) strand; PAM type: YTN; PAM sequence: TTA
cttttttatgattttaagag

SEQ ID NO: 11146 - DNA, 20 bp, Artificial Sequence
  Description of Artificial Sequence: Synthetic oligonucleotide
  Target: ANGPTL3; (-) strand; PAM type: YTN; PAM sequence: TTT
acttttttatgattttaaga

SEQ ID NO: 11147 - DNA, 20 bp, Artificial Sequence
  Description of Artificial Sequence: Synthetic oligonucleotide
  Target: ANGPTL3; (-) strand; PAM type: YTN; PAM sequence: TTT
tacttttttatgattttaag

SEQ ID NO: 11148 - DNA, 20 bp, Artificial Sequence
  Description of Artificial Sequence: Synthetic oligonucleotide
  Target: ANGPTL3; (-) strand; PAM type: YTN; PAM sequence: CTA
attttacttttttatgattt

SEQ ID NO: 11149 - DNA, 20 bp, Artificial Sequence
  Description of Artificial Sequence: Synthetic oligonucleotide
  Target: ANGPTL3; (-) strand; PAM type: YTN; PAM sequence: TTA
aaagctaattttactttttt

SEQ ID NO: 11150 - DNA, 20 bp, Artificial Sequence
  Description of Artificial Sequence: Synthetic oligonucleotide
  Target: ANGPTL3; (-) strand; PAM type: YTN; PAM sequence: TTT
aaaagctaattttacttttt

SEQ ID NO: 11151 - DNA, 20 bp, Artificial Sequence
  Description of Artificial Sequence: Synthetic oligonucleotide
  Target: ANGPTL3; (-) strand; PAM type: YTN; PAM sequence: TTT
taaaagctaattttactttt

SEQ ID NO: 11152 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaagctaattttacttt

SEQ ID NO: 11153 - DNA, 20 bp, Artificial Sequence
  Description of Artificial Sequence: Synthetic oligonucleotide
  Target: ANGPTL3; (-) strand; PAM type: YTN; PAM sequence: CTG
tttttaaaagctaattttac

SEQ ID NO: 11154 - DNA, 20 bp, Artificial Sequence
  Description of Artificial Sequence: Synthetic oligonucleotide
  Target: ANGPTL3; (-) strand; PAM type: YTN; PAM sequence: CTA
cctgtttttaaaagctaatt

SEQ ID NO: 11155 - DNA, 20 bp, Artificial Sequence
  Description of Artificial Sequence: Synthetic oligonucleotide
  Target: ANGPTL3; (-) strand; PAM type: YTN; PAM sequence: CTA
tggtgactacctgtttttaa

SEQ ID NO: 11156 - DNA, 20 bp, Artificial Sequence
  Description of Artificial Sequence: Synthetic oligonucleotide
  Target: ANGPTL3; (-) strand; PAM type: YTN; PAM sequence: TTC
aatgctatggtgactacctg

SEQ ID NO: 11157 - DNA, 20 bp, Artificial Sequence
  Description of Artificial Sequence: Synthetic oligonucleotide
  Target: ANGPTL3; (-) strand; PAM type: YTN; PAM sequence: CTA
cacattcaatgctatggtga

SEQ ID NO: 11158 - DNA, 20 bp, Artificial Sequence
  Description of Artificial Sequence: Synthetic oligonucleotide
  Target: ANGPTL3; (-) strand; PAM type: YTN; PAM sequence: TTA
taaactacacattcaatgct

SEQ ID NO: 11159 - DNA, 20 bp, Artificial Sequence
  Description of Artificial Sequence: Synthetic oligonucleotide
  Target: ANGPTL3; (-) strand; PAM type: YTN; PAM sequence: CTG
tattataaactacacattca

SEQ ID NO: 11160 - DNA, 20 bp, Artificial Sequence
  Description of Artificial Sequence: Synthetic oligonucleotide
  Target: ANGPTL3; (-) strand; PAM type: YTN; PAM sequence: TTG
ctgtattataaactacacat

SEQ ID NO: 11161 - DNA, 20 bp, Artificial Sequence
  Description of Artificial Sequence: Synthetic oligonucleotide
  Target: ANGPTL3; (-) strand; PAM type: YTN; PAM sequence: TTT
gctgtattataaactacaca

SEQ ID NO: 11162 - DNA, 20 bp, Artificial Sequence
  Description of Artificial Sequence: Synthetic oligonucleotide
  Target: ANGPTL3; (-) strand; PAM type: YTN; PAM sequence: CTT
tgctgtattataaactacac

SEQ ID NO: 11163 - DNA, 20 bp, Artificial Sequence
  Description of Artificial Sequence: Synthetic oligonucleotide
  Target: ANGPTL3; (-) strand; PAM type: YTN; PAM sequence: TTA
actttgctgtattataaact

SEQ ID NO: 11164 - DNA, 20 bp, Artificial Sequence
  Description of Artificial Sequence: Synthetic oligonucleotide
  Target: ANGPTL3; (-) strand; PAM type: YTN; PAM sequence: TTT
aactttgctgtattataaac

SEQ ID NO: 11165 - DNA, 20 bp, Artificial Sequence
  Description of Artificial Sequence: Synthetic oligonucleotide
  Target: ANGPTL3; (-) strand; PAM type: YTN; PAM sequence: TTG
tatttaactttgctgtatta

SEQ ID NO: 11166 - DNA, 20 bp, Artificial Sequence
  Description of Artificial Sequence: Synthetic oligonucleotide
  Target: ANGPTL3; (-) strand; PAM type: YTN; PAM sequence: TTG
aaattgtatttaactttgct

SEQ ID NO: 11167 - DNA, 20 bp, Artificial Sequence
  Description of Artificial Sequence: Synthetic oligonucleotide
  Target: ANGPTL3; (-) strand; PAM type: YTN; PAM sequence: TTT
gaaattgtatttaactttgc

SEQ ID NO: 11168 - DNA, 20 bp, Artificial Sequence
  Description of Artificial Sequence: Synthetic oligonucleotide
  Target: ANGPTL3; (-) strand; PAM type: YTN; PAM sequence: TTA
ataggtaatttgaaattgta

SEQ ID NO: 11169 - DNA, 20 bp, Artificial Sequence
  Description of Artificial Sequence: Synthetic oligonucleotide
  Target: ANGPTL3; (-) strand; PAM type: YTN; PAM sequence: CTT
aataggtaatttgaaattgt

SEQ ID NO: 11170 - DNA, 20 bp, Artificial Sequence
  Description of Artificial Sequence: Synthetic oligonucleotide
  Target: ANGPTL3; (-) strand; PAM type: YTN; PAM sequence: CTA
acttaataggtaatttgaaa

SEQ ID NO: 11171 - DNA, 20 bp, Artificial Sequence
  Description of Artificial Sequence: Synthetic oligonucleotide
  Target: ANGPTL3; (-) strand; PAM type: YTN; PAM sequence: CTA
aatgaaatcaaagaaatgag

SEQ ID NO: 11172 - DNA, 20 bp, Artificial Sequence
  Description of Artificial Sequence: Synthetic oligonucleotide
  Target: ANGPTL3; (-) strand; PAM type: YTN; PAM sequence: TTA
gatcaatgctaaatgaaatc

SEQ ID NO: 11173 - DNA, 20 bp, Artificial Sequence
  Description of Artificial Sequence: Synthetic oligonucleotide
  Target: ANGPTL3; (-) strand; PAM type: YTN; PAM sequence: TTG
agttagatcaatgctaaatg

SEQ ID NO: 11174 - DNA, 20 bp, Artificial Sequence
  Description of Artificial Sequence: Synthetic oligonucleotide
  Target: ANGPTL3; (-) strand; PAM type: YTN; PAM sequence: TTC
cacattgagttagatcaatg

SEQ ID NO: 11175 - DNA, 20 bp, Artificial Sequence
  Description of Artificial Sequence: Synthetic oligonucleotide
  Target: ANGPTL3; (-) strand; PAM type: YTN; PAM sequence: CTT
ccacattgagttagatcaat

SEQ ID NO: 11176 - DNA, 20 bp, Artificial Sequence
  Description of Artificial Sequence: Synthetic oligonucleotide
  Target: ANGPTL3; (-) strand; PAM type: YTN; PAM sequence: TTC
ttccacattgagttagatca

SEQ ID NO: 11177 - DNA, 20 bp, Artificial Sequence
  Description of Artificial Sequence: Synthetic oligonucleotide
  Target: ANGPTL3; (-) strand; PAM type: YTN; PAM sequence: CTT
cttccacattgagttagatc

SEQ ID NO: 11178 - DNA, 20 bp, Artificial Sequence
  Description of Artificial Sequence: Synthetic oligonucleotide
  Target: ANGPTL3; (-) strand; PAM type: YTN; PAM sequence: TTG
cacgaatgtaaccttcttcc

SEQ ID NO: 11179 - DNA, 20 bp, Artificial Sequence
  Description of Artificial Sequence: Synthetic oligonucleotide
  Target: ANGPTL3; (-) strand; PAM type: YTN; PAM sequence: CTT
gcacgaatgtaaccttcttc

SEQ ID NO: 11180 - DNA, 20 bp, Artificial Sequence
  Description of Artificial Sequence: Synthetic oligonucleotide
  Target: ANGPTL3; (-) strand; PAM type: YTN; PAM sequence: TTA
acttgcacgaatgtaacctt

SEQ ID NO: 11181 - DNA, 20 bp, Artificial Sequence
  Description of Artificial Sequence: Synthetic oligonucleotide
  Target: ANGPTL3; (-) strand; PAM type: YTN; PAM sequence: TTA
agccgtgttaacttgcacga

SEQ ID NO: 11182 - DNA, 20 bp, Artificial Sequence
  Description of Artificial Sequence: Synthetic oligonucleotide
  Target: ANGPTL3; (-) strand; PAM type: YTN; PAM sequence: TTA
atcattaagccgtgttaact

SEQ ID NO: 11183 - DNA, 20 bp, Artificial Sequence
  Description of Artificial Sequence: Synthetic oligonucleotide
  Target: ANGPTL3; (-) strand; PAM type: YTN; PAM sequence: TTG
gtaggtgaacatagttaatc

SEQ ID NO: 11184 - DNA, 20 bp, Artificial Sequence
  Description of Artificial Sequence: Synthetic oligonucleotide
  Target: ANGPTL3; (-) strand; PAM type: YTN; PAM sequence: TTG
cccagaaaaggtaaggttgg

SEQ ID NO: 11185 - DNA, 20 bp, Artificial Sequence
  Description of Artificial Sequence: Synthetic oligonucleotide
  Target: ANGPTL3; (-) strand; PAM type: YTN; PAM sequence: TTT
gcccagaaaaggtaaggttg

SEQ ID NO: 11186 - DNA, 20 bp, Artificial Sequence
  Description of Artificial Sequence: Synthetic oligonucleotide
  Target: ANGPTL3; (-) strand; PAM type: YTN; PAM sequence: CTA
tatataccaatatttgccca

SEQ ID NO: 11187 - DNA, 20 bp, Artificial Sequence
  Description of Artificial Sequence: Synthetic oligonucleotide
  Target: ANGPTL3; (-) strand; PAM type: YTN; PAM sequence: CTC
tatatataccaatatttgcc

SEQ ID NO: 11188 - DNA, 20 bp, Artificial Sequence
  Description of Artificial Sequence: Synthetic oligonucleotide
  Target: ANGPTL3; (-) strand; PAM type: YTN; PAM sequence: TTA
actctatatataccaatatt

SEQ ID NO: 11189 - DNA, 20 bp, Artificial Sequence
  Description of Artificial Sequence: Synthetic oligonucleotide
  Target: ANGPTL3; (-) strand; PAM type: YTN; PAM sequence: CTT
aactctatatataccaatat

SEQ ID NO: 11190 - DNA, 20 bp, Artificial Sequence
  Description of Artificial Sequence: Synthetic oligonucleotide
  Target: ANGPTL3; (-) strand; PAM type: YTN; PAM sequence: TTC
ttaactctatatataccaat

SEQ ID NO: 11191 - DNA, 20 bp, Artificial Sequence
  Description of Artificial Sequence: Synthetic oligonucleotide
  Target: ANGPTL3; (-) strand; PAM type: YTN; PAM sequence: CTT
cttaactctatatataccaa

SEQ ID NO: 11192 - DNA, 20 bp, Artificial Sequence
  Description of Artificial Sequence: Synthetic oligonucleotide
  Target: ANGPTL3; (-) strand; PAM type: YTN; PAM sequence: CTA
gacttcttaactctatatat

SEQ ID NO: 11193 - DNA, 20 bp, Artificial Sequence
  Description of Artificial Sequence: Synthetic oligonucleotide
  Target: ANGPTL3; (-) strand; PAM type: YTN; PAM sequence: CTG
gaagcagacctagacttctt

SEQ ID NO: 11194 - DNA, 20 bp, Artificial Sequence
  Description of Artificial Sequence: Synthetic oligonucleotide
  Target: ANGPTL3; (-) strand; PAM type: YTN; PAM sequence: TTC
tggaagcagacctagacttc

SEQ ID NO: 11195 - DNA, 20 bp, Artificial Sequence
  Description of Artificial Sequence: Synthetic oligonucleotide
  Target: ANGPTL3; (-) strand; PAM type: YTN; PAM sequence: CTT
ctggaagcagacctagactt

SEQ ID NO: 11196 - DNA, 20 bp, Artificial Sequence
  Description of Artificial Sequence: Synthetic oligonucleotide
  Target: ANGPTL3; (-) strand; PAM type: YTN; PAM sequence: TTC
ttctggaagcagacctagac

SEQ ID NO: 11197 - DNA, 20 bp, Artificial Sequence
  Description of Artificial Sequence: Synthetic oligonucleotide
  Target: ANGPTL3; (-) strand; PAM type: YTN; PAM sequence: TTT
cttctggaagcagacctaga

SEQ ID NO: 11198 - DNA, 20 bp, Artificial Sequence
  Description of Artificial Sequence: Synthetic oligonucleotide
  Target: ANGPTL3; (-) strand; PAM type: YTN; PAM sequence: TTT
tcttctggaagcagacctag

SEQ ID NO: 11199 - DNA, 20 bp, Artificial Sequence
  Description of Artificial Sequence: Synthetic oligonucleotide
  Target: ANGPTL3; (-) strand; PAM type: YTN; PAM sequence: CTG
ttttcttctggaagcagacc

SEQ ID NO: 11200 - DNA, 20 bp, Artificial Sequence
  Description of Artificial Sequence: Synthetic oligonucleotide
  Target: ANGPTL3; (-) strand; PAM type: YTN; PAM sequence: TTC
aagcaacgtggaactgtttt

SEQ ID NO: 11201 - DNA, 20 bp, Artificial Sequence
  Description of Artificial Sequence: Synthetic oligonucleotide
  Target: ANGPTL3; (-) strand; PAM type: YTN; PAM sequence: TTT
caagcaacgtggaactgttt

SEQ ID NO: 11202 - DNA, 20 bp, Artificial Sequence
  Description of Artificial Sequence: Synthetic oligonucleotide
  Target: ANGPTL3; (-) strand; PAM type: YTN; PAM sequence: TTC
aatttcaagcaacgtggaac

SEQ ID NO: 11203 - DNA, 20 bp, Artificial Sequence
  Description of Artificial Sequence: Synthetic oligonucleotide
  Target: ANGPTL3; (-) strand; PAM type: YTN; PAM sequence: TTT
caatttcaagcaacgtggaa

SEQ ID NO: 11204 - DNA, 20 bp, Artificial Sequence
  Description of Artificial Sequence: Synthetic oligonucleotide
  Target: ANGPTL3; (-) strand; PAM type: YTN; PAM sequence: TTT
tcaatttcaagcaacgtgga

SEQ ID NO: 11205 - DNA, 20 bp, Artificial Sequence
  Description of Artificial Sequence: Synthetic oligonucleotide
  Target: ANGPTL3; (-) strand; PAM type: YTN; PAM sequence: TTG
attttcaatttcaagcaacg

SEQ ID NO: 11206 - DNA, 20 bp, Artificial Sequence
  Description of Artificial Sequence: Synthetic oligonucleotide
  Target: ANGPTL3; (-) strand; PAM type: YTN; PAM sequence: CTT
gattttcaatttcaagcaac

SEQ ID NO: 11207 - DNA, 20 bp, Artificial Sequence
  Description of Artificial Sequence: Synthetic oligonucleotide
  Target: ANGPTL3; (-) strand; PAM type: YTN; PAM sequence: TTA
tcttgattttcaatttcaag

SEQ ID NO: 11208 - DNA, 20 bp, Artificial Sequence
  Description of Artificial Sequence: Synthetic oligonucleotide
  Target: ANGPTL3; (-) strand; PAM type: YTN; PAM sequence: TTT
atcttgattttcaatttcaa

SEQ ID NO: 11209 - DNA, 20 bp, Artificial Sequence
  Description of Artificial Sequence: Synthetic oligonucleotide
  Target: ANGPTL3; (-) strand; PAM type: YTN; PAM sequence: TTT
tatcttgattttcaatttca

SEQ ID NO: 11210 - DNA, 20 bp, Artificial Sequence
  Description of Artificial Sequence: Synthetic oligonucleotide
  Target: ANGPTL3; (-) strand; PAM type: YTN; PAM sequence: TTT
ttatcttgattttcaatttc

SEQ ID NO: 11211 - DNA, 20 bp, Artificial Sequence
  Description of Artificial Sequence: Synthetic oligonucleotide
  Target: ANGPTL3; (-) strand; PAM type: YTN; PAM sequence: TTG
tgaacatttttatcttgatt

SEQ ID NO: 11212 - DNA, 20 bp, Artificial Sequence
  Description of Artificial Sequence: Synthetic oligonucleotide
  Target: ANGPTL3; (-) strand; PAM type: YTN; PAM sequence: TTA
attgtgaacatttttatctt

SEQ ID NO: 11213 - DNA, 20 bp, Artificial Sequence
  Description of Artificial Sequence: Synthetic oligonucleotide
  Target: ANGPTL3; (-) strand; PAM type: YTN; PAM sequence: CTT
aattgtgaacatttttatct

SEQ ID NO: 11214 - DNA, 20 bp, Artificial Sequence
  Description of Artificial Sequence: Synthetic oligonucleotide
  Target: ANGPTL3; (-) strand; PAM type: YTN; PAM sequence: CTA
gaggaacaataaaaagaagg

SEQ ID NO: 11215 - DNA, 20 bp, Artificial Sequence
  Description of Artificial Sequence: Synthetic oligonucleotide
  Target: ANGPTL3; (-) strand; PAM type: YTN; PAM sequence: CTG
gaggaaataactagaggaac

SEQ ID NO: 11216 - DNA, 20 bp, Artificial Sequence
  Description of Artificial Sequence: Synthetic oligonucleotide
  Target: ANGPTL3; (-) strand; PAM type: YTN; PAM sequence: TTC
tggaggaaataactagagga

SEQ ID NO: 11217 - DNA, 20 bp, Artificial Sequence
  Description of Artificial Sequence: Synthetic oligonucleotide
  Target: ANGPTL3; (-) strand; PAM type: YTN; PAM sequence: TTG
atcaattctggaggaaataa

SEQ ID NO: 11218 - DNA, 20 bp, Artificial Sequence
  Description of Artificial Sequence: Synthetic oligonucleotide
  Target: ANGPTL3; (-) strand; PAM type: YTN; PAM sequence: CTT
gatcaattctggaggaaata

SEQ ID NO: 11219 - DNA, 20 bp, Artificial Sequence
  Description of Artificial Sequence: Synthetic oligonucleotide
  Target: ANGPTL3; (-) strand; PAM type: YTN; PAM sequence: TTG
tcttgatcaattctggagga

SEQ ID NO: 11220 - DNA, 20 bp, Artificial Sequence
  Description of Artificial Sequence: Synthetic oligonucleotide
  Target: ANGPTL3; (-) strand; PAM type: YTN; PAM sequence: CTG
gagatagagaatcaaatgat

SEQ ID NO: 11221 - DNA, 20 bp, Artificial Sequence
  Description of Artificial Sequence: Synthetic oligonucleotide
  Target: ANGPTL3; (-) strand; PAM type: YTN; PAM sequence: CTC
tggagatagagaatcaaatg

SEQ ID NO: 11222 - DNA, 20 bp, Artificial Sequence
  Description of Artificial Sequence: Synthetic oligonucleotide
  Target: ANGPTL3; (-) strand; PAM type: YTN; PAM sequence: TTG
gctctggagatagagaatca

SEQ ID NO: 11223 - DNA, 20 bp, Artificial Sequence
  Description of Artificial Sequence: Synthetic oligonucleotide
  Target: ANGPTL3; (-) strand; PAM type: YTN; PAM sequence: TTT
ggctctggagatagagaatc

SEQ ID NO: 11224 - DNA, 20 bp, Artificial Sequence
  Description of Artificial Sequence: Synthetic oligonucleotide
  Target: ANGPTL3; (-) strand; PAM type: YTN; PAM sequence: TTT
tggctctggagatagagaat

SEQ ID NO: 11225 - DNA, 20 bp, Artificial Sequence
  Description of Artificial Sequence: Synthetic oligonucleotide
  Target: ANGPTL3; (-) strand; PAM type: YTN; PAM sequence: TTG
attttggctctggagataga

SEQ ID NO: 11226 - DNA, 20 bp, Artificial Sequence
  Description of Artificial Sequence: Synthetic oligonucleotide
  Target: ANGPTL3; (-) strand; PAM type: YTN; PAM sequence: CTT
gattttggctctggagatag

SEQ ID NO: 11227 - DNA, 20 bp, Artificial Sequence
  Description of Artificial Sequence: Synthetic oligonucleotide
  Target: ANGPTL3; (-) strand; PAM type: YTN; PAM sequence: CTA
acatagcaaatcttgatttt

SEQ ID NO: 11228 - DNA, 20 bp, Artificial Sequence
  Description of Artificial Sequence: Synthetic oligonucleotide
  Target: ANGPTL3; (-) strand; PAM type: YTN; PAM sequence: TTA
catcgtctaacatagcaaat

SEQ ID NO: 11229 - DNA, 20 bp, Artificial Sequence
  Description of Artificial Sequence: Synthetic oligonucleotide
  Target: ANGPTL3; (-) strand; PAM type: YTN; PAM sequence: TTT
acatcgtctaacatagcaaa

SEQ ID NO: 11230 - DNA, 20 bp, Artificial Sequence
  Description of Artificial Sequence: Synthetic oligonucleotide
  Target: ANGPTL3; (-) strand; PAM type: YTN; PAM sequence: TTT
tacatcgtctaacatagcaa

SEQ ID NO: 11231 - DNA, 20 bp, Artificial Sequence
  Description of Artificial Sequence: Synthetic oligonucleotide
  Target: ANGPTL3; (-) strand; PAM type: YTN; PAM sequence: TTT
ttacatcgtctaacatagca

SEQ ID NO: 11232 - DNA, 20 bp, Artificial Sequence
  Description of Artificial Sequence: Synthetic oligonucleotide
  Target: ANGPTL3; (-) strand; PAM type: YTN; PAM sequence: CTA
aaatttttacatcgtctaac

SEQ ID NO: 11233 - DNA, 20 bp, Artificial Sequence
  Description of Artificial Sequence: Synthetic oligonucleotide
  Target: ANGPTL3; (-) strand; PAM type: YTN; PAM sequence: TTG
gctaaaatttttacatcgtc

SEQ ID NO: 11234 - DNA, 20 bp, Artificial Sequence
  Description of Artificial Sequence: Synthetic oligonucleotide
  Target: ANGPTL3; (-) strand; PAM type: YTN; PAM sequence: CTG
aaggaggccattggctaaaa

SEQ ID NO: 11235 - DNA, 20 bp, Artificial Sequence
  Description of Artificial Sequence: Synthetic oligonucleotide
  Target: ANGPTL3; (-) strand; PAM type: YTN; PAM sequence: TTA
agaccatgtcccaactgaag

SEQ ID NO: 11236 - DNA, 20 bp, Artificial Sequence
  Description of Artificial Sequence: Synthetic oligonucleotide
  Target: ANGPTL3; (-) strand; PAM type: YTN; PAM sequence: TTT
aagaccatgtcccaactgaa

SEQ ID NO: 11237 - DNA, 20 bp, Artificial Sequence
  Description of Artificial Sequence: Synthetic oligonucleotide
  Target: ANGPTL3; (-) strand; PAM type: YTN; PAM sequence: CTT
taagaccatgtcccaactga

SEQ ID NO: 11238 - DNA, 20 bp, Artificial Sequence
  Description of Artificial Sequence: Synthetic oligonucleotide
  Target: ANGPTL3; (-) strand; PAM type: YTN; PAM sequence: TTA
tggacaaagtctttaagacc

SEQ ID NO: 11239 - DNA, 20 bp, Artificial Sequence
  Description of Artificial Sequence: Synthetic oligonucleotide
  Target: ANGPTL3; (-) strand; PAM type: YTN; PAM sequence: CTT
atggacaaagtctttaagac

SEQ ID NO: 11240 - DNA, 20 bp, Artificial Sequence
  Description of Artificial Sequence: Synthetic oligonucleotide
  Target: ANGPTL3; (-) strand; PAM type: YTN; PAM sequence: TTC
gtcttatggacaaagtcttt

SEQ ID NO: 11241 - DNA, 20 bp, Artificial Sequence
  Description of Artificial Sequence: Synthetic oligonucleotide
  Target: ANGPTL3; (-) strand; PAM type: YTN; PAM sequence: CTT
cgtcttatggacaaagtctt

SEQ ID NO: 11242 - DNA, 20 bp, Artificial Sequence
  Description of Artificial Sequence: Synthetic oligonucleotide
  Target: ANGPTL3; (-) strand; PAM type: YTN; PAM sequence: TTG
gcccttcgtcttatggacaa

SEQ ID NO: 11243 - DNA, 20 bp, Artificial Sequence
  Description of Artificial Sequence: Synthetic oligonucleotide
  Target: ANGPTL3; (-) strand; PAM type: YTN; PAM sequence: TTT
ggcccttcgtcttatggaca

SEQ ID NO: 11244 - DNA, 20 bp, Artificial Sequence
  Description of Artificial Sequence: Synthetic oligonucleotide
  Target: ANGPTL3; (-) strand; PAM type: YTN; PAM sequence: TTA
atttggcccttcgtcttatg

SEQ ID NO: 11245 - DNA, 20 bp, Artificial Sequence
  Description of Artificial Sequence: Synthetic oligonucleotide
  Target: ANGPTL3; (-) strand; PAM type: YTN; PAM sequence: TTG
aaatatgtcattaatttggc

SEQ ID NO: 11246 - DNA, 20 bp, Artificial Sequence
  Description of Artificial Sequence: Synthetic oligonucleotide
  Target: ANGPTL3; (-) strand; PAM type: YTN; PAM sequence: TTT
gaaatatgtcattaatttgg

SEQ ID NO: 11247 - DNA, 20 bp, Artificial Sequence
  Description of Artificial Sequence: Synthetic oligonucleotide
  Target: ANGPTL3; (-) strand; PAM type: YTN; PAM sequence: TTT
tgaaatatgtcattaatttg

SEQ ID NO: 11248 - DNA, 20 bp, Artificial Sequence
  Description of Artificial Sequence: Synthetic oligonucleotide
  Target: ANGPTL3; (-) strand; PAM type: YTN; PAM sequence: TTT
ttgaaatatgtcattaattt

SEQ ID NO: 11249 - DNA, 20 bp, Artificial Sequence
  Description of Artificial Sequence: Synthetic oligonucleotide
  Target: ANGPTL3; (-) strand; PAM type: YTN; PAM sequence: TTG
agtttttgaaatatgtcatt

SEQ ID NO: 11250 - DNA, 20 bp, Artificial Sequence
  Description of Artificial Sequence: Synthetic oligonucleotide
  Target: ANGPTL3; (-) strand; PAM type: YTN; PAM sequence: CTG
atcaaatatgttgagttttt

SEQ ID NO: 11251 - DNA, 20 bp, Artificial Sequence
  Description of Artificial Sequence: Synthetic oligonucleotide
  Target: ANGPTL3; (-) strand; PAM type: YTN; PAM sequence: TTG
cagcgatagatcataaaaag

SEQ ID NO: 11252 - DNA, 20 bp, Artificial Sequence
  Description of Artificial Sequence: Synthetic oligonucleotide
  Target: ANGPTL3; (-) strand; PAM type: YTN; PAM sequence: TTT
gcagcgatagatcataaaaa

SEQ ID NO: 11253 - DNA, 20 bp, Artificial Sequence
  Description of Artificial Sequence: Synthetic oligonucleotide
  Target: ANGPTL3; (-) strand; PAM type: YTN; PAM sequence: CTG
gtttgcagcgatagatcata

SEQ ID NO: 11254 - DNA, 20 bp, Artificial Sequence
  Description of Artificial Sequence: Synthetic oligonucleotide
  Target: ANGPTL3; (-) strand; PAM type: YTN; PAM sequence: TTC
actggtttgcagcgatagat

SEQ ID NO: 11255 - DNA, 20 bp, Artificial Sequence
  Description of Artificial Sequence: Synthetic oligonucleotide
  Target: ANGPTL3; (-) strand; PAM type: YTN; PAM sequence: TTT
cactggtttgcagcgataga

SEQ ID NO: 11256 - DNA, 20 bp, Artificial Sequence
  Description of Artificial Sequence: Synthetic oligonucleotide
  Target: ANGPTL3; (-) strand; PAM type: YTN; PAM sequence: TTG
atttcactggtttgcagcga

SEQ ID NO: 11257 - DNA, 20 bp, Artificial Sequence
  Description of Artificial Sequence: Synthetic oligonucleotide
  Target: ANGPTL3; (-) strand; PAM type: YTN; PAM sequence: TTT
gatttcactggtttgcagcg

SEQ ID NO: 11258 - DNA, 20 bp, Artificial Sequence
  Description of Artificial Sequence: Synthetic oligonucleotide
  Target: ANGPTL3; (-) strand; PAM type: YTN; PAM sequence: CTT
tgatttcactggtttgcagc

SEQ ID NO: 11259 - DNA, 20 bp, Artificial Sequence
  Description of Artificial Sequence: Synthetic oligonucleotide
  Target: ANGPTL3; (-) strand; PAM type: YTN; PAM sequence: TTC
tttgatttcactggtttgca

SEQ ID NO: 11260 - DNA, 20 bp, Artificial Sequence
  Description of Artificial Sequence: Synthetic oligonucleotide
  Target: ANGPTL3; (-) strand; PAM type: YTN; PAM sequence: CTT
ctttgatttcactggtttgc

SEQ ID NO: 11261 - DNA, 20 bp, Artificial Sequence
  Description of Artificial Sequence: Synthetic oligonucleotide
  Target: ANGPTL3; (-) strand; PAM type: YTN; PAM sequence: TTC
ttctttgatttcactggttt

SEQ ID NO: 11262 - DNA, 20 bp, Artificial Sequence
  Description of Artificial Sequence: Synthetic oligonucleotide
  Target: ANGPTL3; (-) strand; PAM type: YTN; PAM sequence: CTT
cttctttgatttcactggtt

SEQ ID NO: 11263 - DNA, 20 bp, Artificial Sequence
  Description of Artificial Sequence: Synthetic oligonucleotide
  Target: ANGPTL3; (-) strand; PAM type: YTN; PAM sequence: TTC
ttcttctttgatttcactgg

SEQ ID NO: 11264 - DNA, 20 bp, Artificial Sequence
  Description of Artificial Sequence: Synthetic oligonucleotide
  Target: ANGPTL3; (-) strand; PAM type: YTN; PAM sequence: TTT
cttcttctttgatttcactg

SEQ ID NO: 11265 - DNA, 20 bp, Artificial Sequence
  Description of Artificial Sequence: Synthetic oligonucleotide
  Target: ANGPTL3; (-) strand; PAM type: YTN; PAM sequence: TTT
tcttcttctttgatttcact

SEQ ID NO: 11266 - DNA, 20 bp, Artificial Sequence
  Description of Artificial Sequence: Synthetic oligonucleotide
  Target: ANGPTL3; (-) strand; PAM type: YTN; PAM sequence: CTT
ttcttcttctttgatttcac

SEQ ID NO: 11267 - DNA, 20 bp, Artificial Sequence
  Description of Artificial Sequence: Synthetic oligonucleotide
  Target: ANGPTL3; (-) strand; PAM type: YTN; PAM sequence: TTC
cttttcttcttctttgattt

SEQ ID NO: 11268 - DNA, 20 bp, Artificial Sequence
  Description of Artificial Sequence: Synthetic oligonucleotide
  Target: ANGPTL3; (-) strand; PAM type: YTN; PAM sequence: CTC
agttccttttcttcttcttt

SEQ ID NO: 11269 - DNA, 20 bp, Artificial Sequence
  Description of Artificial Sequence: Synthetic oligonucleotide
  Target: ANGPTL3; (-) strand; PAM type: YTN; PAM sequence: TTC
tcagttccttttcttcttct

SEQ ID NO: 11270 - DNA, 20 bp, Artificial Sequence
  Description of Artificial Sequence: Synthetic oligonucleotide
  Target: ANGPTL3; (-) strand; PAM type: YTN; PAM sequence: CTT
ctcagttccttttcttcttc

SEQ ID NO: 11271 - DNA, 20 bp, Artificial Sequence
  Description of Artificial Sequence: Synthetic oligonucleotide
  Target: ANGPTL3; (-) strand; PAM type: YTN; PAM sequence: TTC
ttctcagttccttttcttct

SEQ ID NO: 11272 - DNA, 20 bp, Artificial Sequence
  Description of Artificial Sequence: Synthetic oligonucleotide
  Target: ANGPTL3; (-) strand; PAM type: YTN; PAM sequence: TTA
tatgtagttcttctcagttc

SEQ ID NO: 11273 - DNA, 20 bp, Artificial Sequence
  Description of Artificial Sequence: Synthetic oligonucleotide
  Target: ANGPTL3; (-) strand; PAM type: YTN; PAM sequence: TTT
atatgtagttcttctcagtt

SEQ ID NO: 11274 - DNA, 20 bp, Artificial Sequence
  Description of Artificial Sequence: Synthetic oligonucleotide
  Target: ANGPTL3; (-) strand; PAM type: YTN; PAM sequence: TTG
tagtttatatgtagttcttc

SEQ ID NO: 11275 - DNA, 20 bp, Artificial Sequence
  Description of Artificial Sequence: Synthetic oligonucleotide
  Target: ANGPTL3; (-) strand; PAM type: YTN; PAM sequence: CTT
gtagtttatatgtagttctt

SEQ ID NO: 11276 - DNA, 20 bp, Artificial Sequence
  Description of Artificial Sequence: Synthetic oligonucleotide
  Target: ANGPTL3; (-) strand; PAM type: YTN; PAM sequence: TTG
acttgtagtttatatgtagt

SEQ ID NO: 11277 - DNA, 20 bp, Artificial Sequence
  Description of Artificial Sequence: Synthetic oligonucleotide
  Target: ANGPTL3; (-) strand; PAM type: YTN; PAM sequence: TTT
gacttgtagtttatatgtag

SEQ ID NO: 11278 - DNA, 20 bp, Artificial Sequence
  Description of Artificial Sequence: Synthetic oligonucleotide
  Target: ANGPTL3; (-) strand; PAM type: YTN; PAM sequence: TTT
tgacttgtagtttatatgta

SEQ ID NO: 11279 - DNA, 20 bp, Artificial Sequence
  Description of Artificial Sequence: Synthetic oligonucleotide
  Target: ANGPTL3; (-) strand; PAM type: YTN; PAM sequence: TTT
ttgacttgtagtttatatgt

SEQ ID NO: 11280 - DNA, 20 bp, Artificial Sequence
  Description of Artificial Sequence: Synthetic oligonucleotide
  Target: ANGPTL3; (-) strand; PAM type: YTN; PAM sequence: TTC
atttttgacttgtagtttat

SEQ ID NO: 11281 - DNA, 20 bp, Artificial Sequence
  Description of Artificial Sequence: Synthetic oligonucleotide
  Target: ANGPTL3; (-) strand; PAM type: YTN; PAM sequence: CTT
catttttgacttgtagttta

SEQ ID NO: 11282 - DNA, 20 bp, Artificial Sequence
  Description of Artificial Sequence: Synthetic oligonucleotide
  Target: ANGPTL3; (-) strand; PAM type: YTN; PAM sequence: CTC
ttcatttttgacttgtagtt

SEQ ID NO: 11283 - DNA, 20 bp, Artificial Sequence
  Description of Artificial Sequence: Synthetic oligonucleotide
  Target: ANGPTL3; (-) strand; PAM type: YTN; PAM sequence: TTA
cctcttcatttttgacttgt

SEQ ID NO: 11284 - DNA, 20 bp, Artificial Sequence
  Description of Artificial Sequence: Synthetic oligonucleotide
  Target: ANGPTL3; (-) strand; PAM type: YTN; PAM sequence: TTT
acctcttcatttttgacttg

SEQ ID NO: 11285 - DNA, 20 bp, Artificial Sequence
  Description of Artificial Sequence: Synthetic oligonucleotide
  Target: ANGPTL3; (-) strand; PAM type: YTN; PAM sequence: CTT
tacctcttcatttttgactt

SEQ ID NO: 11286 - DNA, 20 bp, Artificial Sequence
  Description of Artificial Sequence: Synthetic oligonucleotide
  Target: ANGPTL3; (-) strand; PAM type: YTN; PAM sequence: TTC
tttacctcttcatttttgac

SEQ ID NO: 11287 - DNA, 20 bp, Artificial Sequence
  Description of Artificial Sequence: Synthetic oligonucleotide
  Target: ANGPTL3; (-) strand; PAM type: YTN; PAM sequence: TTC
aagtgacatattctttacct

SEQ ID NO: 11288 - DNA, 20 bp, Artificial Sequence
  Description of Artificial Sequence: Synthetic oligonucleotide
  Target: ANGPTL3; (-) strand; PAM type: YTN; PAM sequence: TTG
agttcaagtgacatattctt

SEQ ID NO: 11289 - DNA, 20 bp, Artificial Sequence
  Description of Artificial Sequence: Synthetic oligonucleotide
  Target: ANGPTL3; (-) strand; PAM type: YTN; PAM sequence: TTG
agttgagttcaagtgacata

SEQ ID NO: 11290 - DNA, 20 bp, Artificial Sequence
  Description of Artificial Sequence: Synthetic oligonucleotide
  Target: ANGPTL3; (-) strand; PAM type: YTN; PAM sequence: TTT
gagttgagttcaagtgacat

SEQ ID NO: 11291 - DNA, 20 bp, Artificial Sequence
  Description of Artificial Sequence: Synthetic oligonucleotide
  Target: ANGPTL3; (-) strand; PAM type: YTN; PAM sequence: TTT
tgagttgagttcaagtgaca

SEQ ID NO: 11292 - DNA, 20 bp, Artificial Sequence
  Description of Artificial Sequence: Synthetic oligonucleotide
  Target: ANGPTL3; (-) strand; PAM type: YTN; PAM sequence: TTC
aagttttgagttgagttcaa

SEQ ID NO: 11293 - DNA, 20 bp, Artificial Sequence
  Description of Artificial Sequence: Synthetic oligonucleotide
  Target: ANGPTL3; (-) strand; PAM type: YTN; PAM sequence: TTT
caagttttgagttgagttca

SEQ ID NO: 11294 - DNA, 20 bp, Artificial Sequence
  Description of Artificial Sequence: Synthetic oligonucleotide
  Target: ANGPTL3; (-) strand; PAM type: YTN; PAM sequence: CTT
tcaagttttgagttgagttc

SEQ ID NO: 11295 - DNA, 20 bp, Artificial Sequence
  Description of Artificial Sequence: Synthetic oligonucleotide
  Target: ANGPTL3; (-) strand; PAM type: YTN; PAM sequence: CTA
ggaggctttcaagttttgag

SEQ ID NO: 11296 - DNA, 20 bp, Artificial Sequence
  Description of Artificial Sequence: Synthetic oligonucleotide
  Target: ANGPTL3; (-) strand; PAM type: YTN; PAM sequence: TTC
taggaggctttcaagttttg

SEQ ID NO: 11297 - DNA, 20 bp, Artificial Sequence
  Description of Artificial Sequence: Synthetic oligonucleotide
  Target: ANGPTL3; (-) strand; PAM type: YTN; PAM sequence: CTT
ctaggaggctttcaagtttt

SEQ ID NO: 11298 - DNA, 20 bp, Artificial Sequence
  Description of Artificial Sequence: Synthetic oligonucleotide
  Target: ANGPTL3; (-) strand; PAM type: YTN; PAM sequence: TTC
ttctaggaggctttcaagtt

SEQ ID NO: 11299 - DNA, 20 bp, Artificial Sequence
  Description of Artificial Sequence: Synthetic oligonucleotide
  Target: ANGPTL3; (-) strand; PAM type: YTN; PAM sequence: TTT
cttctaggaggctttcaagt

SEQ ID NO: 11300 - DNA, 20 bp, Artificial Sequence
  Description of Artificial Sequence: Synthetic oligonucleotide
  Target: ANGPTL3; (-) strand; PAM type: YTN; PAM sequence: TTT
tcttctaggaggctttcaag

SEQ ID NO: 11301 - DNA, 20 bp, Artificial Sequence
  Description of Artificial Sequence: Synthetic oligonucleotide
  Target: ANGPTL3; (-) strand; PAM type: YTN; PAM sequence: TTT
ttcttctaggaggctttcaa

SEQ ID NO: 11302 - DNA, 20 bp, Artificial Sequence
  Description of Artificial Sequence: Synthetic oligonucleotide
  Target: ANGPTL3; (-) strand; PAM type: YTN; PAM sequence: TTT
tttcttctaggaggctttca

SEQ ID NO: 11303 - DNA, 20 bp, Artificial Sequence
  Description of Artificial Sequence: Synthetic oligonucleotide
  Target: ANGPTL3; (-) strand; PAM type: YTN; PAM sequence: TTG
aagtagaattttttcttcta

SEQ ID NO: 11304 - DNA, 20 bp, Artificial Sequence
  Description of Artificial Sequence: Synthetic oligonucleotide
  Target: ANGPTL3; (-) strand; PAM type: YTN; PAM sequence: TTG
ttgaagtagaattttttctt

SEQ ID NO: 11305 - DNA, 20 bp, Artificial Sequence
  Description of Artificial Sequence: Synthetic oligonucleotide
  Target: ANGPTL3; (-) strand; PAM type: YTN; PAM sequence: TTT
gttgaagtagaattttttct

SEQ ID NO: 11306 - DNA, 20 bp, Artificial Sequence
  Description of Artificial Sequence: Synthetic oligonucleotide
  Target: ANGPTL3; (-) strand; PAM type: YTN; PAM sequence: TTT
tgttgaagtagaattttttc

SEQ ID NO: 11307 - DNA, 20 bp, Artificial Sequence
  Description of Artificial Sequence: Synthetic oligonucleotide
  Target: ANGPTL3; (-) strand; PAM type: YTN; PAM sequence: TTT
ttgttgaagtagaatttttt

SEQ ID NO: 11308 - DNA, 20 bp, Artificial Sequence
  Description of Artificial Sequence: Synthetic oligonucleotide
  Target: ANGPTL3; (-) strand; PAM type: YTN; PAM sequence: CTT
tttgttgaagtagaattttt

SEQ ID NO: 11309 - DNA, 20 bp, Artificial Sequence
  Description of Artificial Sequence: Synthetic oligonucleotide
  Target: ANGPTL3; (-) strand; PAM type: YTN; PAM sequence: TTC
actttttgttgaagtagaat

SEQ ID NO: 11310 - DNA, 20 bp, Artificial Sequence
  Description of Artificial Sequence: Synthetic oligonucleotide
  Target: ANGPTL3; (-) strand; PAM type: YTN; PAM sequence: TTT
cactttttgttgaagtagaa

SEQ ID NO: 11311 - DNA, 20 bp, Artificial Sequence
  Description of Artificial Sequence: Synthetic oligonucleotide
  Target: ANGPTL3; (-) strand; PAM type: YTN; PAM sequence: CTA
aatatttcactttttgttga

SEQ ID NO: 11312 - DNA, 20 bp, Artificial Sequence
  Description of Artificial Sequence: Synthetic oligonucleotide
  Target: ANGPTL3; (-) strand; PAM type: YTN; PAM sequence: TTC
taaatatttcactttttgtt

SEQ ID NO: 11313 - DNA, 20 bp, Artificial Sequence
  Description of Artificial Sequence: Synthetic oligonucleotide
  Target: ANGPTL3; (-) strand; PAM type: YTN; PAM sequence: CTT
ctaaatatttcactttttgt

SEQ ID NO: 11314 - DNA, 20 bp, Artificial Sequence
  Description of Artificial Sequence: Synthetic oligonucleotide
  Target: ANGPTL3; (-) strand; PAM type: YTN; PAM sequence: CTC
ttctaaatatttcacttttt

SEQ ID NO: 11315 - DNA, 20 bp, Artificial Sequence
  Description of Artificial Sequence: Synthetic oligonucleotide
  Target: ANGPTL3; (-) strand; PAM type: YTN; PAM sequence: TTG
ctcttctaaatatttcactt

SEQ ID NO: 11316 - DNA, 20 bp, Artificial Sequence
  Description of Artificial Sequence: Synthetic oligonucleotide
  Target: ANGPTL3; (-) strand; PAM type: YTN; PAM sequence: TTA
gttgctcttctaaatatttc

SEQ ID NO: 11317 - DNA, 20 bp, Artificial Sequence
  Description of Artificial Sequence: Synthetic oligonucleotide
  Target: ANGPTL3; (-) strand; PAM type: YTN; PAM sequence: TTA
gttagttgctcttctaaata

SEQ ID NO: 11318 - DNA, 20 bp, Artificial Sequence
  Description of Artificial Sequence: Synthetic oligonucleotide
  Target: ANGPTL3; (-) strand; PAM type: YTN; PAM sequence: TTA
agttagttagttgctcttct

SEQ ID NO: 11319 - DNA, 20 bp, Artificial Sequence
  Description of Artificial Sequence: Synthetic oligonucleotide
  Target: ANGPTL3; (-) strand; PAM type: YTN; PAM sequence: TTG
aattaagttagttagttgct

SEQ ID NO: 11320 - DNA, 20 bp, Artificial Sequence
  Description of Artificial Sequence: Synthetic oligonucleotide
  Target: ANGPTL3; (-) strand; PAM type: YTN; PAM sequence: TTT
gaattaagttagttagttgc

SEQ ID NO: 11321 - DNA, 20 bp, Artificial Sequence
  Description of Artificial Sequence: Synthetic oligonucleotide
  Target: ANGPTL3; (-) strand; PAM type: YTN; PAM sequence: TTT
tgaattaagttagttagttg

SEQ ID NO: 11322 - DNA, 20 bp, Artificial Sequence
  Description of Artificial Sequence: Synthetic oligonucleotide
  Target: ANGPTL3; (-) strand; PAM type: YTN; PAM sequence: TTG
attttgaattaagttagtta

SEQ ID NO: 11323 - DNA, 20 bp, Artificial Sequence
  Description of Artificial Sequence: Synthetic oligonucleotide
  Target: ANGPTL3; (-) strand; PAM type: YTN; PAM sequence: TTC
aggttgattttgaattaagt

SEQ ID NO: 11324 - DNA, 20 bp, Artificial Sequence
  Description of Artificial Sequence: Synthetic oligonucleotide
  Target: ANGPTL3; (-) strand; PAM type: YTN; PAM sequence: TTT
caggttgattttgaattaag

SEQ ID NO: 11325 - DNA, 20 bp, Artificial Sequence
  Description of Artificial Sequence: Synthetic oligonucleotide
  Target: ANGPTL3; (-) strand; PAM type: YTN; PAM sequence: CTG
gagtttcaggttgattttga

SEQ ID NO: 11326 - DNA, 20 bp, Artificial Sequence
  Description of Artificial Sequence: Synthetic oligonucleotide
  Target: ANGPTL3; (-) strand; PAM type: YTN; PAM sequence: TTC
tggagtttcaggttgatttt

SEQ ID NO: 11327 - DNA, 20 bp, Artificial Sequence
  Description of Artificial Sequence: Synthetic oligonucleotide
  Target: ANGPTL3; (-) strand; PAM type: YTN; PAM sequence: CTG
ggtgttctggagtttcaggt

SEQ ID NO: 11328 - DNA, 20 bp, Artificial Sequence
  Description of Artificial Sequence: Synthetic oligonucleotide
  Target: ANGPTL3; (-) strand; PAM type: YTN; PAM sequence: TTC
tgggtgttctggagtttcag

SEQ ID NO: 11329 - DNA, 20 bp, Artificial Sequence
  Description of Artificial Sequence: Synthetic oligonucleotide
  Target: ANGPTL3; (-) strand; PAM type: YTN; PAM sequence: CTT
ctgggtgttctggagtttca

SEQ ID NO: 11330 - DNA, 20 bp, Artificial Sequence
  Description of Artificial Sequence: Synthetic oligonucleotide
  Target: ANGPTL3; (-) strand; PAM type: YTN; PAM sequence: TTA
cttctgggtgttctggagtt

SEQ ID NO: 11331 - DNA, 20 bp, Artificial Sequence
  Description of Artificial Sequence: Synthetic oligonucleotide
  Target: ANGPTL3; (-) strand; PAM type: YTN; PAM sequence: TTA
agtgaagttacttctgggtg

SEQ ID NO: 11332 - DNA, 20 bp, Artificial Sequence
  Description of Artificial Sequence: Synthetic oligonucleotide
  Target: ANGPTL3; (-) strand; PAM type: YTN; PAM sequence: TTT
aagtgaagttacttctgggt

SEQ ID NO: 11333 - DNA, 20 bp, Artificial Sequence
  Description of Artificial Sequence: Synthetic oligonucleotide
  Target: ANGPTL3; (-) strand; PAM type: YTN; PAM sequence: CTT
taagtgaagttacttctggg

SEQ ID NO: 11334 - DNA, 20 bp, Artificial Sequence
  Description of Artificial Sequence: Synthetic oligonucleotide
  Target: ANGPTL3; (-) strand; PAM type: YTN; PAM sequence: TTA
ctttaagtgaagttacttct

SEQ ID NO: 11335 - DNA, 20 bp, Artificial Sequence
  Description of Artificial Sequence: Synthetic oligonucleotide
  Target: ANGPTL3; (-) strand; PAM type: YTN; PAM sequence: CTT
actttaagtgaagttacttc

SEQ ID NO: 11336 - DNA, 20 bp, Artificial Sequence
  Description of Artificial Sequence: Synthetic oligonucleotide
  Target: ANGPTL3; (-) strand; PAM type: YTN; PAM sequence: CTA
cttactttaagtgaagttac

SEQ ID NO: 11337 - DNA, 20 bp, Artificial Sequence
  Description of Artificial Sequence: Synthetic oligonucleotide
  Target: ANGPTL3; (-) strand; PAM type: YTN; PAM sequence: TTC
tacttactttaagtgaagtt

SEQ ID NO: 11338 - DNA, 20 bp, Artificial Sequence
  Description of Artificial Sequence: Synthetic oligonucleotide
  Target: ANGPTL3; (-) strand; PAM type: YTN; PAM sequence: TTT
ctacttactttaagtgaagt

SEQ ID NO: 11339 - DNA, 20 bp, Artificial Sequence
  Description of Artificial Sequence: Synthetic oligonucleotide
  Target: ANGPTL3; (-) strand; PAM type: YTN; PAM sequence: TTT
tctacttactttaagtgaag

SEQ ID NO: 11340 - DNA, 20 bp, Artificial Sequence
  Description of Artificial Sequence: Synthetic oligonucleotide
  Target: ANGPTL3; (-) strand; PAM type: YTN; PAM sequence: TTA
ttttctacttactttaagtg

SEQ ID NO: 11341 - DNA, 20 bp, Artificial Sequence
  Description of Artificial Sequence: Synthetic oligonucleotide
  Target: ANGPTL3; (-) strand; PAM type: YTN; PAM sequence: TTT
attttctacttactttaagt

SEQ ID NO: 11342 - DNA, 20 bp, Artificial Sequence
  Description of Artificial Sequence: Synthetic oligonucleotide
  Target: ANGPTL3; (-) strand; PAM type: YTN; PAM sequence: CTT
tattttctacttactttaag

SEQ ID NO: 11343 - DNA, 20 bp, Artificial Sequence
  Description of Artificial Sequence: Synthetic oligonucleotide
  Target: ANGPTL3; (-) strand; PAM type: YTN; PAM sequence: CTC
tttattttctacttacttta

SEQ ID NO: 11344 - DNA, 20 bp, Artificial Sequence
  Description of Artificial Sequence: Synthetic oligonucleotide
  Target: ANGPTL3; (-) strand; PAM type: YTN; PAM sequence: TTG
aaaacataaacatgaaccct

SEQ ID NO: 11345 - DNA, 20 bp, Artificial Sequence
  Description of Artificial Sequence: Synthetic oligonucleotide
  Target: ANGPTL3; (-) strand; PAM type: YTN; PAM sequence: TTA
aaagatccacattgaaaaca

SEQ ID NO: 11346 - DNA, 20 bp, Artificial Sequence
  Description of Artificial Sequence: Synthetic oligonucleotide
  Target: ANGPTL3; (-) strand; PAM type: YTN; PAM sequence: TTT
aaaagatccacattgaaaac

SEQ ID NO: 11347 - DNA, 20 bp, Artificial Sequence
  Description of Artificial Sequence: Synthetic oligonucleotide
  Target: ANGPTL3; (-) strand; PAM type: YTN; PAM sequence: TTT
taaaagatccacattgaaaa

SEQ ID NO: 11348 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaagatccacattgaaa

SEQ ID NO: 11349 - DNA, 20 bp, Artificial Sequence
  Description of Artificial Sequence: Synthetic oligonucleotide
  Target: ANGPTL3; (-) strand; PAM type: YTN; PAM sequence: TTT
tttaaaagatccacattgaa

SEQ ID NO: 11350 - DNA, 20 bp, Artificial Sequence
  Description of Artificial Sequence: Synthetic oligonucleotide
  Target: ANGPTL3; (-) strand; PAM type: YTN; PAM sequence: TTT
ttttaaaagatccacattga

SEQ ID NO: 11351 - DNA, 20 bp, Artificial Sequence
  Description of Artificial Sequence: Synthetic oligonucleotide
  Target: ANGPTL3; (-) strand; PAM type: YTN; PAM sequence: TTT
tttttaaaagatccacattg

SEQ ID NO: 11352 - DNA, 20 bp, Artificial Sequence
  Description of Artificial Sequence: Synthetic oligonucleotide
  Target: ANGPTL3; (-) strand; PAM type: YTN; PAM sequence: TTA
gaaatattttttttaaaaga

SEQ ID NO: 11353 - DNA, 20 bp, Artificial Sequence
  Description of Artificial Sequence: Synthetic oligonucleotide
  Target: ANGPTL3; (-) strand; PAM type: YTN; PAM sequence: CTT
agaaatattttttttaaaag

SEQ ID NO: 11354 - DNA, 20 bp, Artificial Sequence
  Description of Artificial Sequence: Synthetic oligonucleotide
  Target: ANGPTL3; (-) strand; PAM type: YTN; PAM sequence: TTC
aaatggcatgccttagaaat

SEQ ID NO: 11355 - DNA, 20 bp, Artificial Sequence
  Description of Artificial Sequence: Synthetic oligonucleotide
  Target: ANGPTL3; (-) strand; PAM type: YTN; PAM sequence: TTT
caaatggcatgccttagaaa

SEQ ID NO: 11356 - DNA, 20 bp, Artificial Sequence
  Description of Artificial Sequence: Synthetic oligonucleotide
  Target: ANGPTL3; (-) strand; PAM type: YTN; PAM sequence: TTC
aacaatgcaacaaagtattt

SEQ ID NO: 11357 - DNA, 20 bp, Artificial Sequence
  Description of Artificial Sequence: Synthetic oligonucleotide
  Target: ANGPTL3; (-) strand; PAM type: YTN; PAM sequence: TTT
caacaatgcaacaaagtatt

SEQ ID NO: 11358 - DNA, 20 bp, Artificial Sequence
  Description of Artificial Sequence: Synthetic oligonucleotide
  Target: ANGPTL3; (-) strand; PAM type: YTN; PAM sequence: TTG
gaaaaaaaagtatttcaaca

SEQ ID NO: 11359 - DNA, 20 bp, Artificial Sequence
  Description of Artificial Sequence: Synthetic oligonucleotide
  Target: ANGPTL3; (-) strand; PAM type: YTN; PAM sequence: CTT
ggaaaaaaaagtatttcaac

SEQ ID NO: 11360 - DNA, 20 bp, Artificial Sequence
  Description of Artificial Sequence: Synthetic oligonucleotide
  Target: ANGPTL3; (-) strand; PAM type: YTN; PAM sequence: TTC
ttggaaaaaaaagtatttca

SEQ ID NO: 11361 - DNA, 20 bp, Artificial Sequence
  Description of Artificial Sequence: Synthetic oligonucleotide
  Target: ANGPTL3; (-) strand; PAM type: YTN; PAM sequence: TTT
cttggaaaaaaaagtatttc

SEQ ID NO: 11362 - DNA, 20 bp, Artificial Sequence
  Description of Artificial Sequence: Synthetic oligonucleotide
  Target: ANGPTL3; (-) strand; PAM type: YTN; PAM sequence: TTT
tcttggaaaaaaaagtattt

SEQ ID NO: 11363 - DNA, 20 bp, Artificial Sequence
  Description of Artificial Sequence: Synthetic oligonucleotide
  Target: ANGPTL3; (-) strand; PAM type: YTN; PAM sequence: TTT
ttcttggaaaaaaaagtatt

SEQ ID NO: 11364 - DNA, 20 bp, Artificial Sequence
  Description of Artificial Sequence: Synthetic oligonucleotide
  Target: ANGPTL3; (-) strand; PAM type: YTN; PAM sequence: TTA
tttttcttggaaaaaaaagt

SEQ ID NO: 11365 - DNA, 20 bp, Artificial Sequence
  Description of Artificial Sequence: Synthetic oligonucleotide
  Target: ANGPTL3; (-) strand; PAM type: YTN; PAM sequence: CTG
gagattatttttcttggaaa

SEQ ID NO: 11366 - DNA, 20 bp, Artificial Sequence
  Description of Artificial Sequence: Synthetic oligonucleotide
  Target: ANGPTL3; (-) strand; PAM type: YTN; PAM sequence: TTC
tggagattatttttcttgga

SEQ ID NO: 11367 - DNA, 20 bp, Artificial Sequence
  Description of Artificial Sequence: Synthetic oligonucleotide
  Target: ANGPTL3; (-) strand; PAM type: YTN; PAM sequence: TTT
ctggagattatttttcttgg

SEQ ID NO: 11368 - DNA, 20 bp, Artificial Sequence
  Description of Artificial Sequence: Synthetic oligonucleotide
  Target: ANGPTL3; (-) strand; PAM type: YTN; PAM sequence: TTT
tctggagattatttttcttg

SEQ ID NO: 11369 - DNA, 20 bp, Artificial Sequence
  Description of Artificial Sequence: Synthetic oligonucleotide
  Target: ANGPTL3; (-) strand; PAM type: YTN; PAM sequence: TTA
ttttctggagattatttttc

SEQ ID NO: 11370 - DNA, 20 bp, Artificial Sequence
  Description of Artificial Sequence: Synthetic oligonucleotide
  Target: ANGPTL3; (-) strand; PAM type: YTN; PAM sequence: TTT
attttctggagattattttt

SEQ ID NO: 11371 - DNA, 20 bp, Artificial Sequence
  Description of Artificial Sequence: Synthetic oligonucleotide
  Target: ANGPTL3; (-) strand; PAM type: YTN; PAM sequence: TTT
tattttctggagattatttt

SEQ ID NO: 11372 - DNA, 20 bp, Artificial Sequence
  Description of Artificial Sequence: Synthetic oligonucleotide
  Target: ANGPTL3; (-) strand; PAM type: YTN; PAM sequence: TTA
taataggaaattttattttc

SEQ ID NO: 11373 - DNA, 20 bp, Artificial Sequence
  Description of Artificial Sequence: Synthetic oligonucleotide
  Target: ANGPTL3; (-) strand; PAM type: YTN; PAM sequence: TTG
aaattataataggaaatttt

SEQ ID NO: 11374 - DNA, 20 bp, Artificial Sequence
  Description of Artificial Sequence: Synthetic oligonucleotide
  Target: ANGPTL3; (-) strand; PAM type: YTN; PAM sequence: CTT
gaaattataataggaaattt

SEQ ID NO: 11375 - DNA, 20 bp, Artificial Sequence
  Description of Artificial Sequence: Synthetic oligonucleotide
  Target: ANGPTL3; (-) strand; PAM type: YTN; PAM sequence: CTA
acttgaaattataataggaa

SEQ ID NO: 11376 - DNA, 20 bp, Artificial Sequence
  Description of Artificial Sequence: Synthetic oligonucleotide
  Target: ANGPTL3; (-) strand; PAM type: YTN; PAM sequence: TTA
gggaaacaaaaaactaactt

SEQ ID NO: 11377 - DNA, 20 bp, Artificial Sequence
  Description of Artificial Sequence: Synthetic oligonucleotide
  Target: ANGPTL3; (-) strand; PAM type: YTN; PAM sequence: TTC
atatataacattagggaaac

SEQ ID NO: 11378 - DNA, 20 bp, Artificial Sequence
  Description of Artificial Sequence: Synthetic oligonucleotide
  Target: ANGPTL3; (-) strand; PAM type: YTN; PAM sequence: TTT
catatataacattagggaaa

SEQ ID NO: 11379 - DNA, 20 bp, Artificial Sequence
  Description of Artificial Sequence: Synthetic oligonucleotide
  Target: ANGPTL3; (-) strand; PAM type: YTN; PAM sequence: TTT
tcatatataacattagggaa

SEQ ID NO: 11380 - DNA, 20 bp, Artificial Sequence
  Description of Artificial Sequence: Synthetic oligonucleotide
  Target: ANGPTL3; (-) strand; PAM type: YTN; PAM sequence: TTC
agtgttttcatatataacat

SEQ ID NO: 11381 - DNA, 20 bp, Artificial Sequence
  Description of Artificial Sequence: Synthetic oligonucleotide
  Target: ANGPTL3; (-) strand; PAM type: YTN; PAM sequence: TTT
cagtgttttcatatataaca

SEQ ID NO: 11382 - DNA, 20 bp, Artificial Sequence
  Description of Artificial Sequence: Synthetic oligonucleotide
  Target: ANGPTL3; (-) strand; PAM type: YTN; PAM sequence: TTT
tcagtgttttcatatataac

SEQ ID NO: 11383 - DNA, 20 bp, Artificial Sequence
  Description of Artificial Sequence: Synthetic oligonucleotide
  Target: ANGPTL3; (-) strand; PAM type: YTN; PAM sequence: TTC
atataaaatgcaaattttca

SEQ ID NO: 11384 - DNA, 20 bp, Artificial Sequence
  Description of Artificial Sequence: Synthetic oligonucleotide
  Target: ANGPTL3; (-) strand; PAM type: YTN; PAM sequence: TTT
catataaaatgcaaattttc

SEQ ID NO: 11385 - DNA, 20 bp, Artificial Sequence
  Description of Artificial Sequence: Synthetic oligonucleotide
  Target: ANGPTL3; (-) strand; PAM type: YTN; PAM sequence: TTT
tcatataaaatgcaaatttt

SEQ ID NO: 11386 - DNA, 20 bp, Artificial Sequence
  Description of Artificial Sequence: Synthetic oligonucleotide
  Target: ANGPTL3; (-) strand; PAM type: YTN; PAM sequence: TTG
taattttcatataaaatgca

SEQ ID NO: 11387 - DNA, 20 bp, Artificial Sequence
  Description of Artificial Sequence: Synthetic oligonucleotide
  Target: ANGPTL3; (-) strand; PAM type: YTN; PAM sequence: TTT
gtaattttcatataaaatgc

SEQ ID NO: 11388 - DNA, 20 bp, Artificial Sequence
  Description of Artificial Sequence: Synthetic oligonucleotide
  Target: ANGPTL3; (-) strand; PAM type: YTN; PAM sequence: TTA
accgatttgtaattttcata

SEQ ID NO: 11389 - DNA, 20 bp, Artificial Sequence
  Description of Artificial Sequence: Synthetic oligonucleotide
  Target: ANGPTL3; (-) strand; PAM type: YTN; PAM sequence: TTT
aaccgatttgtaattttcat

SEQ ID NO: 11390 - DNA, 20 bp, Artificial Sequence
  Description of Artificial Sequence: Synthetic oligonucleotide
  Target: ANGPTL3; (-) strand; PAM type: YTN; PAM sequence: TTG
tataatttaaccgatttgta

SEQ ID NO: 11391 - DNA, 20 bp, Artificial Sequence
  Description of Artificial Sequence: Synthetic oligonucleotide
  Target: ANGPTL3; (-) strand; PAM type: YTN; PAM sequence: CTA
gattgtataatttaaccgat

SEQ ID NO: 11392 - DNA, 20 bp, Artificial Sequence
  Description of Artificial Sequence: Synthetic oligonucleotide
  Target: ANGPTL3; (-) strand; PAM type: YTN; PAM sequence: TTC
tagattgtataatttaaccg

SEQ ID NO: 11393 - DNA, 20 bp, Artificial Sequence
  Description of Artificial Sequence: Synthetic oligonucleotide
  Target: ANGPTL3; (-) strand; PAM type: YTN; PAM sequence: TTA
caatagtgtaatgacatagt

SEQ ID NO: 11394 - DNA, 20 bp, Artificial Sequence
  Description of Artificial Sequence: Synthetic oligonucleotide
  Target: ANGPTL3; (-) strand; PAM type: YTN; PAM sequence: TTT
acaatagtgtaatgacatag

SEQ ID NO: 11395 - DNA, 20 bp, Artificial Sequence
  Description of Artificial Sequence: Synthetic oligonucleotide
  Target: ANGPTL3; (-) strand; PAM type: YTN; PAM sequence: TTC
agtaatttacaatagtgtaa

SEQ ID NO: 11396 - DNA, 20 bp, Artificial Sequence
  Description of Artificial Sequence: Synthetic oligonucleotide
  Target: ANGPTL3; (-) strand; PAM type: YTN; PAM sequence: CTT
cagtaatttacaatagtgta

SEQ ID NO: 11397 - DNA, 20 bp, Artificial Sequence
  Description of Artificial Sequence: Synthetic oligonucleotide
  Target: ANGPTL3; (-) strand; PAM type: YTN; PAM sequence: TTA
ccttcagtaatttacaatag

SEQ ID NO: 11398 - DNA, 20 bp, Artificial Sequence
  Description of Artificial Sequence: Synthetic oligonucleotide
  Target: ANGPTL3; (-) strand; PAM type: YTN; PAM sequence: CTT
accttcagtaatttacaata

SEQ ID NO: 11399 - DNA, 20 bp, Artificial Sequence
  Description of Artificial Sequence: Synthetic oligonucleotide
  Target: ANGPTL3; (-) strand; PAM type: YTN; PAM sequence: TTA
cttaccttcagtaatttaca

SEQ ID NO: 11400 - DNA, 20 bp, Artificial Sequence
  Description of Artificial Sequence: Synthetic oligonucleotide
  Target: ANGPTL3; (-) strand; PAM type: YTN; PAM sequence: TTT
acttaccttcagtaatttac

SEQ ID NO: 11401 - DNA, 20 bp, Artificial Sequence
  Description of Artificial Sequence: Synthetic oligonucleotide
  Target: ANGPTL3; (-) strand; PAM type: YTN; PAM sequence: TTT
tacttaccttcagtaattta

SEQ ID NO: 11402 - DNA, 20 bp, Artificial Sequence
  Description of Artificial Sequence: Synthetic oligonucleotide
  Target: ANGPTL3; (-) strand; PAM type: YTN; PAM sequence: TTT
ttacttaccttcagtaattt

SEQ ID NO: 11403 - DNA, 20 bp, Artificial Sequence
  Description of Artificial Sequence: Synthetic oligonucleotide
  Target: ANGPTL3; (-) strand; PAM type: YTN; PAM sequence: CTT
tttacttaccttcagtaatt

SEQ ID NO: 11404 - DNA, 20 bp, Artificial Sequence
  Description of Artificial Sequence: Synthetic oligonucleotide
  Target: ANGPTL3; (-) strand; PAM type: YTN; PAM sequence: TTA
actttttacttaccttcagt

SEQ ID NO: 11405 - DNA, 20 bp, Artificial Sequence
  Description of Artificial Sequence: Synthetic oligonucleotide
  Target: ANGPTL3; (-) strand; PAM type: YTN; PAM sequence: TTT
aactttttacttaccttcag

SEQ ID NO: 11406 - DNA, 20 bp, Artificial Sequence
  Description of Artificial Sequence: Synthetic oligonucleotide
  Target: ANGPTL3; (-) strand; PAM type: YTN; PAM sequence: TTT
taactttttacttaccttca

SEQ ID NO: 11407 - DNA, 20 bp, Artificial Sequence
  Description of Artificial Sequence: Synthetic oligonucleotide
  Target: ANGPTL3; (-) strand; PAM type: YTN; PAM sequence: TTT
ttaactttttacttaccttc

SEQ ID NO: 11408 - DNA, 20 bp, Artificial Sequence
  Description of Artificial Sequence: Synthetic oligonucleotide
  Target: ANGPTL3; (-) strand; PAM type: YTN; PAM sequence: TTT
tttaactttttacttacctt

SEQ ID NO: 11409 - DNA, 20 bp, Artificial Sequence
  Description of Artificial Sequence: Synthetic oligonucleotide
  Target: ANGPTL3; (-) strand; PAM type: YTN; PAM sequence: TTT
ttttaactttttacttacct

SEQ ID NO: 11410 - DNA, 20 bp, Artificial Sequence
  Description of Artificial Sequence: Synthetic oligonucleotide
  Target: ANGPTL3; (-) strand; PAM type: YTN; PAM sequence: TTT
tttttaactttttacttacc

SEQ ID NO: 11411 - DNA, 20 bp, Artificial Sequence
  Description of Artificial Sequence: Synthetic oligonucleotide
  Target: ANGPTL3; (-) strand; PAM type: YTN; PAM sequence: TTA
aattttttttaactttttac

SEQ ID NO: 11412 - DNA, 20 bp, Artificial Sequence
  Description of Artificial Sequence: Synthetic oligonucleotide
  Target: ANGPTL3; (-) strand; PAM type: YTN; PAM sequence: TTT
aaattttttttaacttttta

SEQ ID NO: 11413 - DNA, 20 bp, Artificial Sequence
  Description of Artificial Sequence: Synthetic oligonucleotide
  Target: ANGPTL3; (-) strand; PAM type: YTN; PAM sequence: TTT
taaattttttttaacttttt

SEQ ID NO: 11414 - DNA, 20 bp, Artificial Sequence
  Description of Artificial Sequence: Synthetic oligonucleotide
  Target: ANGPTL3; (-) strand; PAM type: YTN; PAM sequence: CTG
gagaatagttttaaattttt

SEQ ID NO: 11415 - DNA, 20 bp, Artificial Sequence
  Description of Artificial Sequence: Synthetic oligonucleotide
  Target: ANGPTL3; (-) strand; PAM type: YTN; PAM sequence: TTA
aacactggagaatagtttta

SEQ ID NO: 11416 - DNA, 20 bp, Artificial Sequence
  Description of Artificial Sequence: Synthetic oligonucleotide
  Target: ANGPTL3; (-) strand; PAM type: YTN; PAM sequence: TTT
aaacactggagaatagtttt

SEQ ID NO: 11417 - DNA, 20 bp, Artificial Sequence
  Description of Artificial Sequence: Synthetic oligonucleotide
  Target: ANGPTL3; (-) strand; PAM type: YTN; PAM sequence: TTT
taaacactggagaatagttt

SEQ ID NO: 11418 - DNA, 20 bp, Artificial Sequence
  Description of Artificial Sequence: Synthetic oligonucleotide
  Target: ANGPTL3; (-) strand; PAM type: YTN; PAM sequence: CTG
ttttaaacactggagaatag

SEQ ID NO: 11419 - DNA, 20 bp, Artificial Sequence
  Description of Artificial Sequence: Synthetic oligonucleotide
  Target: ANGPTL3; (-) strand; PAM type: YTN; PAM sequence: TTA
atctgttttaaacactggag

SEQ ID NO: 11420 - DNA, 20 bp, Artificial Sequence
  Description of Artificial Sequence: Synthetic oligonucleotide
  Target: ANGPTL3; (-) strand; PAM type: YTN; PAM sequence: TTT
aatctgttttaaacactgga

SEQ ID NO: 11421 - DNA, 20 bp, Artificial Sequence
  Description of Artificial Sequence: Synthetic oligonucleotide
  Target: ANGPTL3; (-) strand; PAM type: YTN; PAM sequence: TTA
tttaatctgttttaaacact

SEQ ID NO: 11422 - DNA, 20 bp, Artificial Sequence
  Description of Artificial Sequence: Synthetic oligonucleotide
  Target: ANGPTL3; (-) strand; PAM type: YTN; PAM sequence: CTG
tattatttaatctgttttaa

SEQ ID NO: 11423 - DNA, 20 bp, Artificial Sequence
  Description of Artificial Sequence: Synthetic oligonucleotide
  Target: ANGPTL3; (-) strand; PAM type: YTN; PAM sequence: TTA
ctgtattatttaatctgttt

SEQ ID NO: 11424 - DNA, 20 bp, Artificial Sequence
  Description of Artificial Sequence: Synthetic oligonucleotide
  Target: ANGPTL3; (-) strand; PAM type: YTN; PAM sequence: TTT
actgtattatttaatctgtt

SEQ ID NO: 11425 - DNA, 20 bp, Artificial Sequence
  Description of Artificial Sequence: Synthetic oligonucleotide
  Target: ANGPTL3; (-) strand; PAM type: YTN; PAM sequence: TTC
catttactgtattatttaat

SEQ ID NO: 11426 - DNA, 20 bp, Artificial Sequence
  Description of Artificial Sequence: Synthetic oligonucleotide
  Target: ANGPTL3; (-) strand; PAM type: YTN; PAM sequence: TTT
ccatttactgtattatttaa

SEQ ID NO: 11427 - DNA, 20 bp, Artificial Sequence
  Description of Artificial Sequence: Synthetic oligonucleotide
  Target: ANGPTL3; (-) strand; PAM type: YTN; PAM sequence: TTT
tccatttactgtattattta

SEQ ID NO: 11428 - DNA, 20 bp, Artificial Sequence
  Description of Artificial Sequence: Synthetic oligonucleotide
  Target: ANGPTL3; (-) strand; PAM type: YTN; PAM sequence: CTT
ttccatttactgtattattt

SEQ ID NO: 11429 - DNA, 20 bp, Artificial Sequence
  Description of Artificial Sequence: Synthetic oligonucleotide
  Target: ANGPTL3; (-) strand; PAM type: YTN; PAM sequence: TTC
atatgaataaatcttttcca

SEQ ID NO: 11430 - DNA, 20 bp, Artificial Sequence
  Description of Artificial Sequence: Synthetic oligonucleotide
  Target: ANGPTL3; (-) strand; PAM type: YTN; PAM sequence: TTT
catatgaataaatcttttcc

SEQ ID NO: 11431 - DNA, 20 bp, Artificial Sequence
  Description of Artificial Sequence: Synthetic oligonucleotide
  Target: ANGPTL3; (-) strand; PAM type: YTN; PAM sequence: TTT
tcatatgaataaatcttttc

SEQ ID NO: 11432 - DNA, 20 bp, Artificial Sequence
  Description of Artificial Sequence: Synthetic oligonucleotide
  Target: ANGPTL3; (-) strand; PAM type: YTN; PAM sequence: TTA
aaagaaaaagcccagcatat

SEQ ID NO: 11433 - DNA, 20 bp, Artificial Sequence
  Description of Artificial Sequence: Synthetic oligonucleotide
  Target: ANGPTL3; (-) strand; PAM type: YTN; PAM sequence: TTC
aattaaaagaaaaagcccag

SEQ ID NO: 11434 - DNA, 20 bp, Artificial Sequence
  Description of Artificial Sequence: Synthetic oligonucleotide
  Target: ANGPTL3; (-) strand; PAM type: YTN; PAM sequence: CTT
caattaaaagaaaaagccca

SEQ ID NO: 11435 - DNA, 20 bp, Artificial Sequence
  Description of Artificial Sequence: Synthetic oligonucleotide
  Target: ANGPTL3; (-) strand; PAM type: YTN; PAM sequence: CTG
aacttcaattaaaagaaaaa

SEQ ID NO: 11436 - DNA, 20 bp, Artificial Sequence
  Description of Artificial Sequence: Synthetic oligonucleotide
  Target: ANGPTL3; (-) strand; PAM type: YTN; PAM sequence: TTC
tgaacttcaattaaaagaaa

SEQ ID NO: 11437 - DNA, 20 bp, Artificial Sequence
  Description of Artificial Sequence: Synthetic oligonucleotide
  Target: ANGPTL3; (-) strand; PAM type: YTN; PAM sequence: TTT
ctgaacttcaattaaaagaa

SEQ ID NO: 11438 - DNA, 20 bp, Artificial Sequence
  Description of Artificial Sequence: Synthetic oligonucleotide
  Target: ANGPTL3; (-) strand; PAM type: YTN; PAM sequence: TTT
tctgaacttcaattaaaaga

SEQ ID NO: 11439 - DNA, 20 bp, Artificial Sequence
  Description of Artificial Sequence: Synthetic oligonucleotide
  Target: ANGPTL3; (-) strand; PAM type: YTN; PAM sequence: TTG
attttctgaacttcaattaa

SEQ ID NO: 11440 - DNA, 20 bp, Artificial Sequence
  Description of Artificial Sequence: Synthetic oligonucleotide
  Target: ANGPTL3; (-) strand; PAM type: YTN; PAM sequence: TTT
gattttctgaacttcaatta

SEQ ID NO: 11441 - DNA, 20 bp, Artificial Sequence
  Description of Artificial Sequence: Synthetic oligonucleotide
  Target: ANGPTL3; (-) strand; PAM type: YTN; PAM sequence: CTA
aaatttgattttctgaactt

SEQ ID NO: 11442 - DNA, 20 bp, Artificial Sequence
  Description of Artificial Sequence: Synthetic oligonucleotide
  Target: ANGPTL3; (-) strand; PAM type: YTN; PAM sequence: CTC
taaaatttgattttctgaac

SEQ ID NO: 11443 - DNA, 20 bp, Artificial Sequence
  Description of Artificial Sequence: Synthetic oligonucleotide
  Target: ANGPTL3; (-) strand; PAM type: YTN; PAM sequence: CTA
tctctaaaatttgattttct

SEQ ID NO: 11444 - DNA, 20 bp, Artificial Sequence
  Description of Artificial Sequence: Synthetic oligonucleotide
  Target: ANGPTL3; (-) strand; PAM type: YTN; PAM sequence: TTG
tactatctctaaaatttgat

SEQ ID NO: 11445 - DNA, 20 bp, Artificial Sequence
  Description of Artificial Sequence: Synthetic oligonucleotide
  Target: ANGPTL3; (-) strand; PAM type: YTN; PAM sequence: TTA
aattgtactatctctaaaat

SEQ ID NO: 11446 - DNA, 20 bp, Artificial Sequence
  Description of Artificial Sequence: Synthetic oligonucleotide
  Target: ANGPTL3; (-) strand; PAM type: YTN; PAM sequence: TTT
aaattgtactatctctaaaa

SEQ ID NO: 11447 - DNA, 20 bp, Artificial Sequence
  Description of Artificial Sequence: Synthetic oligonucleotide
  Target: ANGPTL3; (-) strand; PAM type: YTN; PAM sequence: TTA
tttaaattgtactatctcta

SEQ ID NO: 11448 - DNA, 20 bp, Artificial Sequence
  Description of Artificial Sequence: Synthetic oligonucleotide
  Target: ANGPTL3; (-) strand; PAM type: YTN; PAM sequence: TTT
atttaaattgtactatctct

SEQ ID NO: 11449 - DNA, 20 bp, Artificial Sequence
  Description of Artificial Sequence: Synthetic oligonucleotide
  Target: ANGPTL3; (-) strand; PAM type: YTN; PAM sequence: TTT
tatttaaattgtactatctc

SEQ ID NO: 11450 - DNA, 20 bp, Artificial Sequence
  Description of Artificial Sequence: Synthetic oligonucleotide
  Target: ANGPTL3; (-) strand; PAM type: YTN; PAM sequence: TTA
acattttatttaaattgtac

SEQ ID NO: 11451 - DNA, 20 bp, Artificial Sequence
  Description of Artificial Sequence: Synthetic oligonucleotide
  Target: ANGPTL3; (-) strand; PAM type: YTN; PAM sequence: CTT
aacattttatttaaattgta

SEQ ID NO: 11452 - DNA, 20 bp, Artificial Sequence
  Description of Artificial Sequence: Synthetic oligonucleotide
  Target: ANGPTL3; (-) strand; PAM type: YTN; PAM sequence: TTG
tccttaacattttatttaaa

SEQ ID NO: 11453 - DNA, 20 bp, Artificial Sequence
  Description of Artificial Sequence: Synthetic oligonucleotide
  Target: ANGPTL3; (-) strand; PAM type: YTN; PAM sequence: TTT
gtccttaacattttatttaa

SEQ ID NO: 11454 - DNA, 20 bp, Artificial Sequence
  Description of Artificial Sequence: Synthetic oligonucleotide
  Target: ANGPTL3; (-) strand; PAM type: YTN; PAM sequence: TTT
tgtccttaacattttattta

SEQ ID NO: 11455 - DNA, 20 bp, Artificial Sequence
  Description of Artificial Sequence: Synthetic oligonucleotide
  Target: ANGPTL3; (-) strand; PAM type: YTN; PAM sequence: TTT
ttgtccttaacattttattt

SEQ ID NO: 11456 - DNA, 20 bp, Artificial Sequence
  Description of Artificial Sequence: Synthetic oligonucleotide
  Target: ANGPTL3; (-) strand; PAM type: YTN; PAM sequence: TTC
aaatagcacatatttttgtc

SEQ ID NO: 11457 - DNA, 20 bp, Artificial Sequence
  Description of Artificial Sequence: Synthetic oligonucleotide
  Target: ANGPTL3; (-) strand; PAM type: YTN; PAM sequence: TTT
caaatagcacatatttttgt

SEQ ID NO: 11458 - DNA, 20 bp, Artificial Sequence
  Description of Artificial Sequence: Synthetic oligonucleotide
  Target: ANGPTL3; (-) strand; PAM type: YTN; PAM sequence: CTT
tcaaatagcacatatttttg

SEQ ID NO: 11459 - DNA, 20 bp, Artificial Sequence
  Description of Artificial Sequence: Synthetic oligonucleotide
  Target: ANGPTL3; (-) strand; PAM type: YTN; PAM sequence: TTC
tttcaaatagcacatatttt

SEQ ID NO: 11460 - DNA, 20 bp, Artificial Sequence
  Description of Artificial Sequence: Synthetic oligonucleotide
  Target: ANGPTL3; (-) strand; PAM type: YTN; PAM sequence: CTT
ctttcaaatagcacatattt

SEQ ID NO: 11461 - DNA, 20 bp, Artificial Sequence
  Description of Artificial Sequence: Synthetic oligonucleotide
  Target: ANGPTL3; (-) strand; PAM type: YTN; PAM sequence: TTG
tatgcttctttcaaatagca

SEQ ID NO: 11462 - DNA, 20 bp, Artificial Sequence
  Description of Artificial Sequence: Synthetic oligonucleotide
  Target: ANGPTL3; (-) strand; PAM type: YTN; PAM sequence: CTT
gtatgcttctttcaaatagc

SEQ ID NO: 11463 - DNA, 20 bp, Artificial Sequence
  Description of Artificial Sequence: Synthetic oligonucleotide
  Target: ANGPTL3; (-) strand; PAM type: YTN; PAM sequence: TTC
cccttgtatgcttctttcaa

SEQ ID NO: 11464 - DNA, 20 bp, Artificial Sequence
  Description of Artificial Sequence: Synthetic oligonucleotide
  Target: ANGPTL3; (-) strand; PAM type: YTN; PAM sequence: CTT
ccccttgtatgcttctttca

SEQ ID NO: 11465 - DNA, 20 bp, Artificial Sequence
  Description of Artificial Sequence: Synthetic oligonucleotide
  Target: ANGPTL3; (-) strand; PAM type: YTN; PAM sequence: TTC
cttccccttgtatgcttctt

SEQ ID NO: 11466 - DNA, 20 bp, Artificial Sequence
  Description of Artificial Sequence: Synthetic oligonucleotide
  Target: ANGPTL3; (-) strand; PAM type: YTN; PAM sequence: TTG
gcaattccttccccttgtat

SEQ ID NO: 11467 - DNA, 20 bp, Artificial Sequence
  Description of Artificial Sequence: Synthetic oligonucleotide
  Target: ANGPTL3; (-) strand; PAM type: YTN; PAM sequence: TTG
aaaaatgaatattggcaatt

SEQ ID NO: 11468 - DNA, 20 bp, Artificial Sequence
  Description of Artificial Sequence: Synthetic oligonucleotide
  Target: ANGPTL3; (-) strand; PAM type: YTN; PAM sequence: TTT
gaaaaatgaatattggcaat

SEQ ID NO: 11469 - DNA, 20 bp, Artificial Sequence
  Description of Artificial Sequence: Synthetic oligonucleotide
  Target: ANGPTL3; (-) strand; PAM type: YTN; PAM sequence: CTA
ataatggatttgaaaaatga

SEQ ID NO: 11470 - DNA, 20 bp, Artificial Sequence
  Description of Artificial Sequence: Synthetic oligonucleotide
  Target: ANGPTL3; (-) strand; PAM type: YTN; PAM sequence: TTA
aactaataatggatttgaaa

SEQ ID NO: 11471 - DNA, 20 bp, Artificial Sequence
  Description of Artificial Sequence: Synthetic oligonucleotide
  Target: ANGPTL3; (-) strand; PAM type: YTN; PAM sequence: TTT
aaactaataatggatttgaa

SEQ ID NO: 11472 - DNA, 20 bp, Artificial Sequence
  Description of Artificial Sequence: Synthetic oligonucleotide
  Target: ANGPTL3; (-) strand; PAM type: YTN; PAM sequence: TTT
taaactaataatggatttga

SEQ ID NO: 11473 - DNA, 20 bp, Artificial Sequence
  Description of Artificial Sequence: Synthetic oligonucleotide
  Target: ANGPTL3; (-) strand; PAM type: YTN; PAM sequence: TTT
ttaaactaataatggatttg

SEQ ID NO: 11474 - DNA, 20 bp, Artificial Sequence
  Description of Artificial Sequence: Synthetic oligonucleotide
  Target: ANGPTL3; (-) strand; PAM type: YTN; PAM sequence: CTA
aatttttaaactaataatgg

SEQ ID NO: 11475 - DNA, 20 bp, Artificial Sequence
  Description of Artificial Sequence: Synthetic oligonucleotide
  Target: ANGPTL3; (-) strand; PAM type: YTN; PAM sequence: CTA
tcataatctaaatttttaaa

SEQ ID NO: 11476 - DNA, 20 bp, Artificial Sequence
  Description of Artificial Sequence: Synthetic oligonucleotide
  Target: ANGPTL3; (-) strand; PAM type: YTN; PAM sequence: CTG
taacactatcataatctaaa

SEQ ID NO: 11477 - DNA, 20 bp, Artificial Sequence
  Description of Artificial Sequence: Synthetic oligonucleotide
  Target: ANGPTL3; (-) strand; PAM type: YTN; PAM sequence: TTC
ctgtaacactatcataatct

SEQ ID NO: 11478 - DNA, 20 bp, Artificial Sequence
  Description of Artificial Sequence: Synthetic oligonucleotide
  Target: ANGPTL3; (-) strand; PAM type: YTN; PAM sequence: TTT
cctgtaacactatcataatc

SEQ ID NO: 11479 - DNA, 20 bp, Artificial Sequence
  Description of Artificial Sequence: Synthetic oligonucleotide
  Target: ANGPTL3; (-) strand; PAM type: YTN; PAM sequence: TTA
atttcctgtaacactatcat

SEQ ID NO: 11480 - DNA, 20 bp, Artificial Sequence
  Description of Artificial Sequence: Synthetic oligonucleotide
  Target: ANGPTL3; (-) strand; PAM type: YTN; PAM sequence: CTA
ttaatttcctgtaacactat

SEQ ID NO: 11481 - DNA, 20 bp, Artificial Sequence
  Description of Artificial Sequence: Synthetic oligonucleotide
  Target: ANGPTL3; (-) strand; PAM type: YTN; PAM sequence: TTC
tattaatttcctgtaacact

SEQ ID NO: 11482 - DNA, 20 bp, Artificial Sequence
  Description of Artificial Sequence: Synthetic oligonucleotide
  Target: ANGPTL3; (-) strand; PAM type: YTN; PAM sequence: TTT
ctattaatttcctgtaacac

SEQ ID NO: 11483 - DNA, 20 bp, Artificial Sequence
  Description of Artificial Sequence: Synthetic oligonucleotide
  Target: ANGPTL3; (-) strand; PAM type: YTN; PAM sequence: TTT
tctattaatttcctgtaaca

SEQ ID NO: 11484 - DNA, 20 bp, Artificial Sequence
  Description of Artificial Sequence: Synthetic oligonucleotide
  Target: ANGPTL3; (-) strand; PAM type: YTN; PAM sequence: CTT
ttctattaatttcctgtaac

SEQ ID NO: 11485 - DNA, 20 bp, Artificial Sequence
  Description of Artificial Sequence: Synthetic oligonucleotide
  Target: ANGPTL3; (-) strand; PAM type: YTN; PAM sequence: TTC
ttttctattaatttcctgta

SEQ ID NO: 11486 - DNA, 20 bp, Artificial Sequence
  Description of Artificial Sequence: Synthetic oligonucleotide
  Target: ANGPTL3; (-) strand; PAM type: YTN; PAM sequence: TTT
cttttctattaatttcctgt

SEQ ID NO: 11487 - DNA, 20 bp, Artificial Sequence
  Description of Artificial Sequence: Synthetic oligonucleotide
  Target: ANGPTL3; (-) strand; PAM type: YTN; PAM sequence: CTT
tcttttctattaatttcctg

SEQ ID NO: 11488 - DNA, 20 bp, Artificial Sequence
  Description of Artificial Sequence: Synthetic oligonucleotide
  Target: ANGPTL3; (-) strand; PAM type: YTN; PAM sequence: CTC
tttcttttctattaatttcc

SEQ ID NO: 11489 - DNA, 20 bp, Artificial Sequence
  Description of Artificial Sequence: Synthetic oligonucleotide
  Target: ANGPTL3; (-) strand; PAM type: YTN; PAM sequence: TTC
ctctttcttttctattaatt

SEQ ID NO: 11490 - DNA, 20 bp, Artificial Sequence
  Description of Artificial Sequence: Synthetic oligonucleotide
  Target: ANGPTL3; (-) strand; PAM type: YTN; PAM sequence: TTT
cctctttcttttctattaat

SEQ ID NO: 11491 - DNA, 20 bp, Artificial Sequence
  Description of Artificial Sequence: Synthetic oligonucleotide
  Target: ANGPTL3; (-) strand; PAM type: YTN; PAM sequence: CTT
tcctctttcttttctattaa

SEQ ID NO: 11492 - DNA, 20 bp, Artificial Sequence
  Description of Artificial Sequence: Synthetic oligonucleotide
  Target: ANGPTL3; (-) strand; PAM type: YTN; PAM sequence: TTG
ctttcctctttcttttctat

SEQ ID NO: 11493 - DNA, 20 bp, Artificial Sequence
  Description of Artificial Sequence: Synthetic oligonucleotide
  Target: ANGPTL3; (-) strand; PAM type: YTN; PAM sequence: TTA
taagttgctttcctctttct

SEQ ID NO: 11494 - DNA, 20 bp, Artificial Sequence
  Description of Artificial Sequence: Synthetic oligonucleotide
  Target: ANGPTL3; (-) strand; PAM type: YTN; PAM sequence: TTG
gttataagttgctttcctct

SEQ ID NO: 11495 - DNA, 20 bp, Artificial Sequence
  Description of Artificial Sequence: Synthetic oligonucleotide
  Target: ANGPTL3; (-) strand; PAM type: YTN; PAM sequence: CTG
gatatagagagtaggttggt

SEQ ID NO: 11496 - DNA, 20 bp, Artificial Sequence
  Description of Artificial Sequence: Synthetic oligonucleotide
  Target: ANGPTL3; (-) strand; PAM type: YTN; PAM sequence: CTA
caaaagtctggatatagaga

SEQ ID NO: 11497 - DNA, 20 bp, Artificial Sequence
  Description of Artificial Sequence: Synthetic oligonucleotide
  Target: ANGPTL3; (-) strand; PAM type: YTN; PAM sequence: TTC
tacaaaagtctggatataga

SEQ ID NO: 11498 - DNA, 20 bp, Artificial Sequence
  Description of Artificial Sequence: Synthetic oligonucleotide
  Target: ANGPTL3; (-) strand; PAM type: YTN; PAM sequence: TTT
ctacaaaagtctggatatag

SEQ ID NO: 11499 - DNA, 20 bp, Artificial Sequence
  Description of Artificial Sequence: Synthetic oligonucleotide
  Target: ANGPTL3; (-) strand; PAM type: YTN; PAM sequence: TTT
tctacaaaagtctggatata

SEQ ID NO: 11500 - DNA, 20 bp, Artificial Sequence
  Description of Artificial Sequence: Synthetic oligonucleotide
  Target: ANGPTL3; (-) strand; PAM type: YTN; PAM sequence: TTT
ttctacaaaagtctggatat

SEQ ID NO: 11501 - DNA, 20 bp, Artificial Sequence
  Description of Artificial Sequence: Synthetic oligonucleotide
  Target: ANGPTL3; (-) strand; PAM type: YTN; PAM sequence: TTG
tttttctacaaaagtctgga

SEQ ID NO: 11502 - DNA, 20 bp, Artificial Sequence
  Description of Artificial Sequence: Synthetic oligonucleotide
  Target: ANGPTL3; (-) strand; PAM type: YTN; PAM sequence: CTT
gtttttctacaaaagtctgg

SEQ ID NO: 11503 - DNA, 20 bp, Artificial Sequence
  Description of Artificial Sequence: Synthetic oligonucleotide
  Target: ANGPTL3; (-) strand; PAM type: YTN; PAM sequence: TTA
tcttgtttttctacaaaagt

SEQ ID NO: 11504 - DNA, 20 bp, Artificial Sequence
  Description of Artificial Sequence: Synthetic oligonucleotide
  Target: ANGPTL3; (-) strand; PAM type: YTN; PAM sequence: CTA
ttatcttgtttttctacaaa

SEQ ID NO: 11505 - DNA, 20 bp, Artificial Sequence
  Description of Artificial Sequence: Synthetic oligonucleotide
  Target: ANGPTL3; (-) strand; PAM type: YTN; PAM sequence: TTG
atgctattatcttgtttttc

SEQ ID NO: 11506 - DNA, 20 bp, Artificial Sequence
  Description of Artificial Sequence: Synthetic oligonucleotide
  Target: ANGPTL3; (-) strand; PAM type: YTN; PAM sequence: TTT
gatgctattatcttgttttt

SEQ ID NO: 11507 - DNA, 20 bp, Artificial Sequence
  Description of Artificial Sequence: Synthetic oligonucleotide
  Target: ANGPTL3; (-) strand; PAM type: YTN; PAM sequence: CTT
tgatgctattatcttgtttt

SEQ ID NO: 11508 - DNA, 20 bp, Artificial Sequence
  Description of Artificial Sequence: Synthetic oligonucleotide
  Target: ANGPTL3; (-) strand; PAM type: YTN; PAM sequence: CTG
gagaaggtctttgatgctat

SEQ ID NO: 11509 - DNA, 20 bp, Artificial Sequence
  Description of Artificial Sequence: Synthetic oligonucleotide
  Target: ANGPTL3; (-) strand; PAM type: YTN; PAM sequence: TTC
cacggtctggagaaggtctt

SEQ ID NO: 11510 - DNA, 20 bp, Artificial Sequence
  Description of Artificial Sequence: Synthetic oligonucleotide
  Target: ANGPTL3; (-) strand; PAM type: YTN; PAM sequence: CTT
ccacggtctggagaaggtct

SEQ ID NO: 11511 - DNA, 20 bp, Artificial Sequence
  Description of Artificial Sequence: Synthetic oligonucleotide
  Target: ANGPTL3; (-) strand; PAM type: YTN; PAM sequence: TTG
gtcttccacggtctggagaa

SEQ ID NO: 11512 - DNA, 20 bp, Artificial Sequence
  Description of Artificial Sequence: Synthetic oligonucleotide
  Target: ANGPTL3; (-) strand; PAM type: YTN; PAM sequence: TTA
tattggtcttccacggtctg

SEQ ID NO: 11513 - DNA, 20 bp, Artificial Sequence
  Description of Artificial Sequence: Synthetic oligonucleotide
  Target: ANGPTL3; (-) strand; PAM type: YTN; PAM sequence: TTT
atattggtcttccacggtct

SEQ ID NO: 11514 - DNA, 20 bp, Artificial Sequence
  Description of Artificial Sequence: Synthetic oligonucleotide
  Target: ANGPTL3; (-) strand; PAM type: YTN; PAM sequence: TTG
tttatattggtcttccacgg

SEQ ID NO: 11515 - DNA, 20 bp, Artificial Sequence
  Description of Artificial Sequence: Synthetic oligonucleotide
  Target: ANGPTL3; (-) strand; PAM type: YTN; PAM sequence: TTA
attgtttatattggtcttcc

SEQ ID NO: 11516 - DNA, 20 bp, Artificial Sequence
  Description of Artificial Sequence: Synthetic oligonucleotide
  Target: ANGPTL3; (-) strand; PAM type: YTN; PAM sequence: TTT
aattgtttatattggtcttc

SEQ ID NO: 11517 - DNA, 20 bp, Artificial Sequence
  Description of Artificial Sequence: Synthetic oligonucleotide
  Target: ANGPTL3; (-) strand; PAM type: YTN; PAM sequence: TTG
gtttaattgtttatattggt

SEQ ID NO: 11518 - DNA, 20 bp, Artificial Sequence
  Description of Artificial Sequence: Synthetic oligonucleotide
  Target: ANGPTL3; (-) strand; PAM type: YTN; PAM sequence: CTG
ttggtttaattgtttatatt

SEQ ID NO: 11519 - DNA, 20 bp, Artificial Sequence
  Description of Artificial Sequence: Synthetic oligonucleotide
  Target: ANGPTL3; (-) strand; PAM type: YTN; PAM sequence: CTA
tgctgttggtttaattgttt

SEQ ID NO: 11520 - DNA, 20 bp, Artificial Sequence
  Description of Artificial Sequence: Synthetic oligonucleotide
  Target: ANGPTL3; (-) strand; PAM type: YTN; PAM sequence: TTG
actatgctgttggtttaatt

SEQ ID NO: 11521 - DNA, 20 bp, Artificial Sequence
  Description of Artificial Sequence: Synthetic oligonucleotide
  Target: ANGPTL3; (-) strand; PAM type: YTN; PAM sequence: TTT
gactatgctgttggtttaat

SEQ ID NO: 11522 - DNA, 20 bp, Artificial Sequence
  Description of Artificial Sequence: Synthetic oligonucleotide
  Target: ANGPTL3; (-) strand; PAM type: YTN; PAM sequence: TTA
tttgactatgctgttggttt

SEQ ID NO: 11523 - DNA, 20 bp, Artificial Sequence
  Description of Artificial Sequence: Synthetic oligonucleotide
  Target: ANGPTL3; (-) strand; PAM type: YTN; PAM sequence: TTT
atttgactatgctgttggtt

SEQ ID NO: 11524 - DNA, 20 bp, Artificial Sequence
  Description of Artificial Sequence: Synthetic oligonucleotide
  Target: ANGPTL3; (-) strand; PAM type: YTN; PAM sequence: TTT
tatttgactatgctgttggt

SEQ ID NO: 11525 - DNA, 20 bp, Artificial Sequence
  Description of Artificial Sequence: Synthetic oligonucleotide
  Target: ANGPTL3; (-) strand; PAM type: YTN; PAM sequence: CTT
ttatttgactatgctgttgg

SEQ ID NO: 11526 - DNA, 20 bp, Artificial Sequence
  Description of Artificial Sequence: Synthetic oligonucleotide
  Target: ANGPTL3; (-) strand; PAM type: YTN; PAM sequence: TTC
ttttatttgactatgctgtt

SEQ ID NO: 11527 - DNA, 20 bp, Artificial Sequence
  Description of Artificial Sequence: Synthetic oligonucleotide
  Target: ANGPTL3; (-) strand; PAM type: YTN; PAM sequence: TTT
cttttatttgactatgctgt

SEQ ID NO: 11528 - DNA, 20 bp, Artificial Sequence
  Description of Artificial Sequence: Synthetic oligonucleotide
  Target: ANGPTL3; (-) strand; PAM type: YTN; PAM sequence: CTA
tttcttttatttgactatgc

SEQ ID NO: 11529 - DNA, 20 bp, Artificial Sequence
  Description of Artificial Sequence: Synthetic oligonucleotide
  Target: ANGPTL3; (-) strand; PAM type: YTN; PAM sequence: TTC
tatttcttttatttgactat

SEQ ID NO: 11530 - DNA, 20 bp, Artificial Sequence
  Description of Artificial Sequence: Synthetic oligonucleotide
  Target: ANGPTL3; (-) strand; PAM type: YTN; PAM sequence: TTT
ctatttcttttatttgacta

SEQ ID NO: 11531 - DNA, 20 bp, Artificial Sequence
  Description of Artificial Sequence: Synthetic oligonucleotide
  Target: ANGPTL3; (-) strand; PAM type: YTN; PAM sequence: TTT
tctatttcttttatttgact

SEQ ID NO: 11532 - DNA, 20 bp, Artificial Sequence
  Description of Artificial Sequence: Synthetic oligonucleotide
  Target: ANGPTL3; (-) strand; PAM type: YTN; PAM sequence: CTG
attttctatttcttttattt

SEQ ID NO: 11533 - DNA, 20 bp, Artificial Sequence
  Description of Artificial Sequence: Synthetic oligonucleotide
  Target: ANGPTL3; (-) strand; PAM type: YTN; PAM sequence: TTA
cctgattttctatttctttt

SEQ ID NO: 11534 - DNA, 20 bp, Artificial Sequence
  Description of Artificial Sequence: Synthetic oligonucleotide
  Target: ANGPTL3; (-) strand; PAM type: YTN; PAM sequence: CTT
acctgattttctatttcttt

SEQ ID NO: 11535 - DNA, 20 bp, Artificial Sequence
  Description of Artificial Sequence: Synthetic oligonucleotide
  Target: ANGPTL3; (-) strand; PAM type: YTN; PAM sequence: CTG
acttacctgattttctattt

SEQ ID NO: 11536 - DNA, 20 bp, Artificial Sequence
  Description of Artificial Sequence: Synthetic oligonucleotide
  Target: ANGPTL3; (-) strand; PAM type: YTN; PAM sequence: TTA
aaatactgacttacctgatt

SEQ ID NO: 11537 - DNA, 20 bp, Artificial Sequence
  Description of Artificial Sequence: Synthetic oligonucleotide
  Target: ANGPTL3; (-) strand; PAM type: YTN; PAM sequence: CTG
tgtgaaagatgggacatacc

SEQ ID NO: 11538 - DNA, 20 bp, Artificial Sequence
  Description of Artificial Sequence: Synthetic oligonucleotide
  Target: ANGPTL3; (-) strand; PAM type: YTN; PAM sequence: TTA
cagacctgtgtgaaagatgg

SEQ ID NO: 11539 - DNA, 20 bp, Artificial Sequence
  Description of Artificial Sequence: Synthetic oligonucleotide
  Target: ANGPTL3; (-) strand; PAM type: YTN; PAM sequence: TTT
acagacctgtgtgaaagatg

SEQ ID NO: 11540 - DNA, 20 bp, Artificial Sequence
  Description of Artificial Sequence: Synthetic oligonucleotide
  Target: ANGPTL3; (-) strand; PAM type: YTN; PAM sequence: TTT
tacagacctgtgtgaaagat

SEQ ID NO: 11541 - DNA, 20 bp, Artificial Sequence
  Description of Artificial Sequence: Synthetic oligonucleotide
  Target: ANGPTL3; (-) strand; PAM type: YTN; PAM sequence: TTT
ttacagacctgtgtgaaaga

SEQ ID NO: 11542 - DNA, 20 bp, Artificial Sequence
  Description of Artificial Sequence: Synthetic oligonucleotide
  Target: ANGPTL3; (-) strand; PAM type: YTN; PAM sequence: TTC
agtgtttttacagacctgtg

SEQ ID NO: 11543 - DNA, 20 bp, Artificial Sequence
  Description of Artificial Sequence: Synthetic oligonucleotide
  Target: ANGPTL3; (-) strand; PAM type: YTN; PAM sequence: TTA
ggattcagtgtttttacaga

SEQ ID NO: 11544 - DNA, 20 bp, Artificial Sequence
  Description of Artificial Sequence: Synthetic oligonucleotide
  Target: ANGPTL3; (-) strand; PAM type: YTN; PAM sequence: TTT
aggattcagtgtttttacag

SEQ ID NO: 11545 - DNA, 20 bp, Artificial Sequence
  Description of Artificial Sequence: Synthetic oligonucleotide
  Target: ANGPTL3; (-) strand; PAM type: YTN; PAM sequence: TTT
taggattcagtgtttttaca

SEQ ID NO: 11546 - DNA, 20 bp, Artificial Sequence
  Description of Artificial Sequence: Synthetic oligonucleotide
  Target: ANGPTL3; (-) strand; PAM type: YTN; PAM sequence: TTG
taaataattttaggattcag

SEQ ID NO: 11547 - DNA, 20 bp, Artificial Sequence
  Description of Artificial Sequence: Synthetic oligonucleotide
  Target: ANGPTL3; (-) strand; PAM type: YTN; PAM sequence: CTT
gtaaataattttaggattca

SEQ ID NO: 11548 - DNA, 20 bp, Artificial Sequence
  Description of Artificial Sequence: Synthetic oligonucleotide
  Target: ANGPTL3; (-) strand; PAM type: YTN; PAM sequence: TTA
aagcttgtaaataattttag

SEQ ID NO: 11549 - DNA, 20 bp, Artificial Sequence
  Description of Artificial Sequence: Synthetic oligonucleotide
  Target: ANGPTL3; (-) strand; PAM type: YTN; PAM sequence: CTC
atgatccagttaaagcttgt

SEQ ID NO: 11550 - DNA, 20 bp, Artificial Sequence
  Description of Artificial Sequence: Synthetic oligonucleotide
  Target: ANGPTL3; (-) strand; PAM type: YTN; PAM sequence: TTA
ctcatgatccagttaaagct

SEQ ID NO: 11551 - DNA, 20 bp, Artificial Sequence
  Description of Artificial Sequence: Synthetic oligonucleotide
  Target: ANGPTL3; (-) strand; PAM type: YTN; PAM sequence: TTT
actcatgatccagttaaagc

SEQ ID NO: 11552 - DNA, 20 bp, Artificial Sequence
  Description of Artificial Sequence: Synthetic oligonucleotide
  Target: ANGPTL3; (-) strand; PAM type: YTN; PAM sequence: TTT
tactcatgatccagttaaag

SEQ ID NO: 11553 - DNA, 20 bp, Artificial Sequence
  Description of Artificial Sequence: Synthetic oligonucleotide
  Target: ANGPTL3; (-) strand; PAM type: YTN; PAM sequence: CTG
atgtgataattttactcatg

SEQ ID NO: 11554 - DNA, 20 bp, Artificial Sequence
  Description of Artificial Sequence: Synthetic oligonucleotide
  Target: ANGPTL3; (-) strand; PAM type: YTN; PAM sequence: TTA
tgctgatgtgataattttac

SEQ ID NO: 11555 - DNA, 20 bp, Artificial Sequence
  Description of Artificial Sequence: Synthetic oligonucleotide
  Target: ANGPTL3; (-) strand; PAM type: YTN; PAM sequence: TTA
acagttatgctgatgtgata

SEQ ID NO: 11556 - DNA, 20 bp, Artificial Sequence
  Description of Artificial Sequence: Synthetic oligonucleotide
  Target: ANGPTL3; (-) strand; PAM type: YTN; PAM sequence: TTT
aacagttatgctgatgtgat

SEQ ID NO: 11557 - DNA, 20 bp, Artificial Sequence
  Description of Artificial Sequence: Synthetic oligonucleotide
  Target: ANGPTL3; (-) strand; PAM type: YTN; PAM sequence: TTT
taacagttatgctgatgtga

SEQ ID NO: 11558 - DNA, 20 bp, Artificial Sequence
  Description of Artificial Sequence: Synthetic oligonucleotide
  Target: ANGPTL3; (-) strand; PAM type: YTN; PAM sequence: CTG
caattttaacagttatgctg

SEQ ID NO: 11559 - DNA, 20 bp, Artificial Sequence
  Description of Artificial Sequence: Synthetic oligonucleotide
  Target: ANGPTL3; (-) strand; PAM type: YTN; PAM sequence: TTC
agagcctgcaattttaacag

SEQ ID NO: 11560 - DNA, 20 bp, Artificial Sequence
  Description of Artificial Sequence: Synthetic oligonucleotide
  Target: ANGPTL3; (-) strand; PAM type: YTN; PAM sequence: CTT
cagagcctgcaattttaaca

SEQ ID NO: 11561 - DNA, 20 bp, Artificial Sequence
  Description of Artificial Sequence: Synthetic oligonucleotide
  Target: ANGPTL3; (-) strand; PAM type: YTN; PAM sequence: TTA
gcttcagagcctgcaatttt

SEQ ID NO: 11562 - DNA, 20 bp, Artificial Sequence
  Description of Artificial Sequence: Synthetic oligonucleotide
  Target: ANGPTL3; (-) strand; PAM type: YTN; PAM sequence: TTA
ttagcttcagagcctgcaat

SEQ ID NO: 11563 - DNA, 20 bp, Artificial Sequence
  Description of Artificial Sequence: Synthetic oligonucleotide
  Target: ANGPTL3; (-) strand; PAM type: YTN; PAM sequence: TTT
attagcttcagagcctgcaa

SEQ ID NO: 11564 - DNA, 20 bp, Artificial Sequence
  Description of Artificial Sequence: Synthetic oligonucleotide
  Target: ANGPTL3; (-) strand; PAM type: YTN; PAM sequence: TTA
aatgcaggtagtttattagc

SEQ ID NO: 11565 - DNA, 20 bp, Artificial Sequence
  Description of Artificial Sequence: Synthetic oligonucleotide
  Target: ANGPTL3; (-) strand; PAM type: YTN; PAM sequence: TTT
aaatgcaggtagtttattag

SEQ ID NO: 11566 - DNA, 20 bp, Artificial Sequence
  Description of Artificial Sequence: Synthetic oligonucleotide
  Target: ANGPTL3; (-) strand; PAM type: YTN; PAM sequence: TTA
gagccatggtttaaatgcag

SEQ ID NO: 11567 - DNA, 20 bp, Artificial Sequence
  Description of Artificial Sequence: Synthetic oligonucleotide
  Target: ANGPTL3; (-) strand; PAM type: YTN; PAM sequence: TTT
agagccatggtttaaatgca

SEQ ID NO: 11568 - DNA, 20 bp, Artificial Sequence
  Description of Artificial Sequence: Synthetic oligonucleotide
  Target: ANGPTL3; (-) strand; PAM type: YTN; PAM sequence: TTT
tagagccatggtttaaatgc

SEQ ID NO: 11569 - DNA, 20 bp, Artificial Sequence
  Description of Artificial Sequence: Synthetic oligonucleotide
  Target: ANGPTL3; (-) strand; PAM type: YTN; PAM sequence: TTC
aaggtcacacaaagttttag

SEQ ID NO: 11570 - DNA, 20 bp, Artificial Sequence
  Description of Artificial Sequence: Synthetic oligonucleotide
  Target: ANGPTL3; (-) strand; PAM type: YTN; PAM sequence: TTA
ttcaaggtcacacaaagttt

SEQ ID NO: 11571 - DNA, 20 bp, Artificial Sequence
  Description of Artificial Sequence: Synthetic oligonucleotide
  Target: ANGPTL3; (-) strand; PAM type: YTN; PAM sequence: TTT
attcaaggtcacacaaagtt

SEQ ID NO: 11572 - DNA, 20 bp, Artificial Sequence
  Description of Artificial Sequence: Synthetic oligonucleotide
  Target: ANGPTL3; (-) strand; PAM type: YTN; PAM sequence: CTG
agagataaaggggtgaagta

SEQ ID NO: 11573 - DNA, 20 bp, Artificial Sequence
  Description of Artificial Sequence: Synthetic oligonucleotide
  Target: ANGPTL3; (-) strand; PAM type: YTN; PAM sequence: TTG
tagtatatgtgaggaaactg

SEQ ID NO: 11574 - DNA, 20 bp, Artificial Sequence
  Description of Artificial Sequence: Synthetic oligonucleotide
  Target: ANGPTL3; (-) strand; PAM type: YTN; PAM sequence: TTT
gtagtatatgtgaggaaact

SEQ ID NO: 11575 - DNA, 20 bp, Artificial Sequence
  Description of Artificial Sequence: Synthetic oligonucleotide
  Target: ANGPTL3; (-) strand; PAM type: YTN; PAM sequence: CTT
tgtagtatatgtgaggaaac

SEQ ID NO: 11576 - DNA, 20 bp, Artificial Sequence
  Description of Artificial Sequence: Synthetic oligonucleotide
  Target: ANGPTL3; (-) strand; PAM type: YTN; PAM sequence: TTA
tctttgtagtatatgtgagg

SEQ ID NO: 11577 - DNA, 20 bp, Artificial Sequence
  Description of Artificial Sequence: Synthetic oligonucleotide
  Target: ANGPTL3; (-) strand; PAM type: YTN; PAM sequence: TTA
ttatctttgtagtatatgtg

SEQ ID NO: 11578 - DNA, 20 bp, Artificial Sequence
  Description of Artificial Sequence: Synthetic oligonucleotide
  Target: ANGPTL3; (-) strand; PAM type: YTN; PAM sequence: CTG
ttattatctttgtagtatat

SEQ ID NO: 11579 - DNA, 20 bp, Artificial Sequence
  Description of Artificial Sequence: Synthetic oligonucleotide
  Target: ANGPTL3; (-) strand; PAM type: YTN; PAM sequence: TTC
tgttattatctttgtagtat

SEQ ID NO: 11580 - DNA, 20 bp, Artificial Sequence
  Description of Artificial Sequence: Synthetic oligonucleotide
  Target: ANGPTL3; (-) strand; PAM type: YTN; PAM sequence: CTA
taagttctgttattatcttt

SEQ ID NO: 11581 - DNA, 20 bp, Artificial Sequence
  Description of Artificial Sequence: Synthetic oligonucleotide
  Target: ANGPTL3; (-) strand; PAM type: YTN; PAM sequence: TTA
caataatcctataagttctg

SEQ ID NO: 11582 - DNA, 20 bp, Artificial Sequence
  Description of Artificial Sequence: Synthetic oligonucleotide
  Target: ANGPTL3; (-) strand; PAM type: YTN; PAM sequence: CTT
acaataatcctataagttct

SEQ ID NO: 11583 - DNA, 20 bp, Artificial Sequence
  Description of Artificial Sequence: Synthetic oligonucleotide
  Target: ANGPTL3; (-) strand; PAM type: YTN; PAM sequence: TTC
ttacaataatcctataagtt

SEQ ID NO: 11584 - DNA, 20 bp, Artificial Sequence
  Description of Artificial Sequence: Synthetic oligonucleotide
  Target: ANGPTL3; (-) strand; PAM type: YTN; PAM sequence: TTT
cttacaataatcctataagt

SEQ ID NO: 11585 - DNA, 20 bp, Artificial Sequence
  Description of Artificial Sequence: Synthetic oligonucleotide
  Target: ANGPTL3; (-) strand; PAM type: YTN; PAM sequence: TTT
tcttacaataatcctataag

SEQ ID NO: 11586 - DNA, 20 bp, Artificial Sequence
  Description of Artificial Sequence: Synthetic oligonucleotide
  Target: ANGPTL3; (-) strand; PAM type: YTN; PAM sequence: TTT
ttcttacaataatcctataa

SEQ ID NO: 11587 - DNA, 20 bp, Artificial Sequence
  Description of Artificial Sequence: Synthetic oligonucleotide
  Target: ANGPTL3; (-) strand; PAM type: YTN; PAM sequence: TTT
tttcttacaataatcctata

SEQ ID NO: 11588 - DNA, 20 bp, Artificial Sequence
  Description of Artificial Sequence: Synthetic oligonucleotide
  Target: ANGPTL3; (-) strand; PAM type: YTN; PAM sequence: TTT
ttttcttacaataatcctat

SEQ ID NO: 11589 - DNA, 20 bp, Artificial Sequence
  Description of Artificial Sequence: Synthetic oligonucleotide
  Target: ANGPTL3; (-) strand; PAM type: YTN; PAM sequence: TTT
tttttcttacaataatccta

SEQ ID NO: 11590 - DNA, 20 bp, Artificial Sequence
  Description of Artificial Sequence: Synthetic oligonucleotide
  Target: ANGPTL3; (-) strand; PAM type: YTN; PAM sequence: TTA
attttttttcttacaataat

SEQ ID NO: 11591 - DNA, 20 bp, Artificial Sequence
  Description of Artificial Sequence: Synthetic oligonucleotide
  Target: ANGPTL3; (-) strand; PAM type: YTN; PAM sequence: CTA
tgaattaattttttttctta

SEQ ID NO: 11592 - DNA, 20 bp, Artificial Sequence
  Description of Artificial Sequence: Synthetic oligonucleotide
  Target: ANGPTL3; (-) strand; PAM type: YTN; PAM sequence: CTG
ctatgaattaattttttttc

SEQ ID NO: 11593 - DNA, 20 bp, Artificial Sequence
  Description of Artificial Sequence: Synthetic oligonucleotide
  Target: ANGPTL3; (-) strand; PAM type: YTN; PAM sequence: TTG
gctgctatgaattaattttt

SEQ ID NO: 11594 - DNA, 20 bp, Artificial Sequence
  Description of Artificial Sequence: Synthetic oligonucleotide
  Target: ANGPTL3; (-) strand; PAM type: YTN; PAM sequence: TTA
gtaagatgacattggctgct

SEQ ID NO: 11595 - DNA, 20 bp, Artificial Sequence
  Description of Artificial Sequence: Synthetic oligonucleotide
  Target: ANGPTL3; (-) strand; PAM type: YTN; PAM sequence: TTT
agtaagatgacattggctgc

SEQ ID NO: 11596 - DNA, 20 bp, Artificial Sequence
  Description of Artificial Sequence: Synthetic oligonucleotide
  Target: ANGPTL3; (-) strand; PAM type: YTN; PAM sequence: TTT
tagtaagatgacattggctg

SEQ ID NO: 11597 - DNA, 20 bp, Artificial Sequence
  Description of Artificial Sequence: Synthetic oligonucleotide
  Target: ANGPTL3; (-) strand; PAM type: YTN; PAM sequence: TTG
aattttagtaagatgacatt

SEQ ID NO: 11598 - DNA, 20 bp, Artificial Sequence
  Description of Artificial Sequence: Synthetic oligonucleotide
  Target: ANGPTL3; (-) strand; PAM type: YTN; PAM sequence: TTT
gaattttagtaagatgacat

SEQ ID NO: 11599 - DNA, 20 bp, Artificial Sequence
  Description of Artificial Sequence: Synthetic oligonucleotide
  Target: ANGPTL3; (-) strand; PAM type: YTN; PAM sequence: CTA
atttgaattttagtaagatg

SEQ ID NO: 11600 - DNA, 20 bp, Artificial Sequence
  Description of Artificial Sequence: Synthetic oligonucleotide
  Target: ANGPTL3; (-) strand; PAM type: YTN; PAM sequence: TTG
agcaaagagaaacatgatct

SEQ ID NO: 11601 - DNA, 20 bp, Artificial Sequence
  Description of Artificial Sequence: Synthetic oligonucleotide
  Target: ANGPTL3; (-) strand; PAM type: YTN; PAM sequence: TTT
gagcaaagagaaacatgatc

SEQ ID NO: 11602 - DNA, 20 bp, Artificial Sequence
  Description of Artificial Sequence: Synthetic oligonucleotide
  Target: ANGPTL3; (-) strand; PAM type: YTN; PAM sequence: TTT
tgagcaaagagaaacatgat

SEQ ID NO: 11603 - DNA, 20 bp, Artificial Sequence
  Description of Artificial Sequence: Synthetic oligonucleotide
  Target: ANGPTL3; (-) strand; PAM type: YTN; PAM sequence: TTG
tgtggttttgagcaaagaga

SEQ ID NO: 11604 - DNA, 20 bp, Artificial Sequence
  Description of Artificial Sequence: Synthetic oligonucleotide
  Target: ANGPTL3; (-) strand; PAM type: YTN; PAM sequence: CTA
ttgtgtggttttgagcaaag

SEQ ID NO: 11605 - DNA, 20 bp, Artificial Sequence
  Description of Artificial Sequence: Synthetic oligonucleotide
  Target: ANGPTL3; (-) strand; PAM type: YTN; PAM sequence: CTA
aagagccaatatgagtgaaa

SEQ ID NO: 11606 - DNA, 20 bp, Artificial Sequence
  Description of Artificial Sequence: Synthetic oligonucleotide
  Target: ANGPTL3; (-) strand; PAM type: YTN; PAM sequence: TTG
gtctaaagagccaatatgag

SEQ ID NO: 11607 - DNA, 20 bp, Artificial Sequence
  Description of Artificial Sequence: Synthetic oligonucleotide
  Target: ANGPTL3; (-) strand; PAM type: YTN; PAM sequence: CTT
ggtctaaagagccaatatga

SEQ ID NO: 11608 - DNA, 20 bp, Artificial Sequence
  Description of Artificial Sequence: Synthetic oligonucleotide
  Target: ANGPTL3; (-) strand; PAM type: YTN; PAM sequence: TTG
ggtaatcttggtctaaagag

SEQ ID NO: 11609 - DNA, 20 bp, Artificial Sequence
  Description of Artificial Sequence: Synthetic oligonucleotide
  Target: ANGPTL3; (-) strand; PAM type: YTN; PAM sequence: CTA
gagtagaggaggtgaagtca

SEQ ID NO: 11610 - DNA, 20 bp, Artificial Sequence
  Description of Artificial Sequence: Synthetic oligonucleotide
  Target: ANGPTL3; (-) strand; PAM type: YTN; PAM sequence: CTG
gtaaagcggtcagaataact

SEQ ID NO: 11611 - DNA, 20 bp, Artificial Sequence
  Description of Artificial Sequence: Synthetic oligonucleotide
  Target: ANGPTL3; (-) strand; PAM type: YTN; PAM sequence: TTG
aatactggtaaagcggtcag

SEQ ID NO: 11612 - DNA, 20 bp, Artificial Sequence
  Description of Artificial Sequence: Synthetic oligonucleotide
  Target: ANGPTL3; (-) strand; PAM type: YTN; PAM sequence: TTT
gaatactggtaaagcggtca

SEQ ID NO: 11613 - DNA, 20 bp, Artificial Sequence
  Description of Artificial Sequence: Synthetic oligonucleotide
  Target: ANGPTL3; (-) strand; PAM type: YTN; PAM sequence: TTG
atgtgtttgaatactggtaa

SEQ ID NO: 11614 - DNA, 20 bp, Artificial Sequence
  Description of Artificial Sequence: Synthetic oligonucleotide
  Target: ANGPTL3; (-) strand; PAM type: YTN; PAM sequence: TTT
gatgtgtttgaatactggta

SEQ ID NO: 11615 - DNA, 20 bp, Artificial Sequence
  Description of Artificial Sequence: Synthetic oligonucleotide
  Target: ANGPTL3; (-) strand; PAM type: YTN; PAM sequence: TTG
aggtggcagtatgtttgatg

SEQ ID NO: 11616 - DNA, 20 bp, Artificial Sequence
  Description of Artificial Sequence: Synthetic oligonucleotide
  Target: ANGPTL3; (-) strand; PAM type: YTN; PAM sequence: TTT
gaggtggcagtatgtttgat

SEQ ID NO: 11617 - DNA, 20 bp, Artificial Sequence
  Description of Artificial Sequence: Synthetic oligonucleotide
  Target: ANGPTL3; (-) strand; PAM type: YTN; PAM sequence: CTT
tgaggtggcagtatgtttga

SEQ ID NO: 11618 - DNA, 20 bp, Artificial Sequence
  Description of Artificial Sequence: Synthetic oligonucleotide
  Target: ANGPTL3; (-) strand; PAM type: YTN; PAM sequence: TTA
gaggaaacaacaagggcaaa

SEQ ID NO: 11619 - DNA, 20 bp, Artificial Sequence
  Description of Artificial Sequence: Synthetic oligonucleotide
  Target: ANGPTL3; (-) strand; PAM type: YTN; PAM sequence: TTC
cagttagaggaaacaacaag

SEQ ID NO: 11620 - DNA, 20 bp, Artificial Sequence
  Description of Artificial Sequence: Synthetic oligonucleotide
  Target: ANGPTL3; (-) strand; PAM type: YTN; PAM sequence: CTA
agggaaatcagagagtgggc

SEQ ID NO: 11621 - DNA, 20 bp, Artificial Sequence
  Description of Artificial Sequence: Synthetic oligonucleotide
  Target: ANGPTL3; (-) strand; PAM type: YTN; PAM sequence: TTG
ataacgaccctaagggaaat

SEQ ID NO: 11622 - DNA, 20 bp, Artificial Sequence
  Description of Artificial Sequence: Synthetic oligonucleotide
  Target: ANGPTL3; (-) strand; PAM type: YTN; PAM sequence: TTT
gataacgaccctaagggaaa

SEQ ID NO: 11623 - DNA, 20 bp, Artificial Sequence
  Description of Artificial Sequence: Synthetic oligonucleotide
  Target: ANGPTL3; (-) strand; PAM type: YTN; PAM sequence: TTG
tttgataacgaccctaaggg

SEQ ID NO: 11624 - DNA, 20 bp, Artificial Sequence
  Description of Artificial Sequence: Synthetic oligonucleotide
  Target: ANGPTL3; (-) strand; PAM type: YTN; PAM sequence: TTT
gtttgataacgaccctaagg

SEQ ID NO: 11625 - DNA, 20 bp, Artificial Sequence
  Description of Artificial Sequence: Synthetic oligonucleotide
  Target: ANGPTL3; (-) strand; PAM type: YTN; PAM sequence: TTT
tgtttgataacgaccctaag

SEQ ID NO: 11626 - DNA, 20 bp, Artificial Sequence
  Description of Artificial Sequence: Synthetic oligonucleotide
  Target: ANGPTL3; (-) strand; PAM type: YTN; PAM sequence: TTT
ttgtttgataacgaccctaa

SEQ ID NO: 11627 - DNA, 20 bp, Artificial Sequence
  Description of Artificial Sequence: Synthetic oligonucleotide
  Target: ANGPTL3; (-) strand; PAM type: YTN; PAM sequence: TTT
tttgtttgataacgacccta

SEQ ID NO: 11628 - DNA, 20 bp, Artificial Sequence
  Description of Artificial Sequence: Synthetic oligonucleotide
  Target: ANGPTL3; (-) strand; PAM type: YTN; PAM sequence: TTG
ggaattttttgtttgataac

SEQ ID NO: 11629 - DNA, 20 bp, Artificial Sequence
  Description of Artificial Sequence: Synthetic oligonucleotide
  Target: ANGPTL3; (-) strand; PAM type: YTN; PAM sequence: TTC
attgggaattttttgtttga

SEQ ID NO: 11630 - DNA, 20 bp, Artificial Sequence
  Description of Artificial Sequence: Synthetic oligonucleotide
  Target: ANGPTL3; (-) strand; PAM type: YTN; PAM sequence: CTT
cattgggaattttttgtttg

SEQ ID NO: 11631 - DNA, 20 bp, Artificial Sequence
  Description of Artificial Sequence: Synthetic oligonucleotide
  Target: ANGPTL3; (-) strand; PAM type: YTN; PAM sequence: TTG
taagtcttcattgggaattt

SEQ ID NO: 11632 - DNA, 20 bp, Artificial Sequence
  Description of Artificial Sequence: Synthetic oligonucleotide
  Target: ANGPTL3; (-) strand; PAM type: YTN; PAM sequence: CTT
gtaagtcttcattgggaatt

SEQ ID NO: 11633 - DNA, 20 bp, Artificial Sequence
  Description of Artificial Sequence: Synthetic oligonucleotide
  Target: ANGPTL3; (-) strand; PAM type: YTN; PAM sequence: TTA
agtgaccttgtaagtcttca

SEQ ID NO: 11634 - DNA, 20 bp, Artificial Sequence
  Description of Artificial Sequence: Synthetic oligonucleotide
  Target: ANGPTL3; (-) strand; PAM type: YTN; PAM sequence: TTG
gttaagtgaccttgtaagtc

SEQ ID NO: 11635 - DNA, 20 bp, Artificial Sequence
  Description of Artificial Sequence: Synthetic oligonucleotide
  Target: ANGPTL3; (-) strand; PAM type: YTN; PAM sequence: TTT
ggttaagtgaccttgtaagt

SEQ ID NO: 11636 - DNA, 20 bp, Artificial Sequence
  Description of Artificial Sequence: Synthetic oligonucleotide
  Target: ANGPTL3; (-) strand; PAM type: YTN; PAM sequence: TTT
tggttaagtgaccttgtaag

SEQ ID NO: 11637 - DNA, 20 bp, Artificial Sequence
  Description of Artificial Sequence: Synthetic oligonucleotide
  Target: ANGPTL3; (-) strand; PAM type: YTN; PAM sequence: TTT
ttggttaagtgaccttgtaa

SEQ ID NO: 11638 - DNA, 20 bp, Artificial Sequence
  Description of Artificial Sequence: Synthetic oligonucleotide
  Target: ANGPTL3; (-) strand; PAM type: YTN; PAM sequence: TTG
tgatttttggttaagtgacc

SEQ ID NO: 11639 - DNA, 20 bp, Artificial Sequence
  Description of Artificial Sequence: Synthetic oligonucleotide
  Target: ANGPTL3; (-) strand; PAM type: YTN; PAM sequence: TTC
agggatgggaccaggcggtt

SEQ ID NO: 11640 - DNA, 20 bp, Artificial Sequence
  Description of Artificial Sequence: Synthetic oligonucleotide
  Target: ANGPTL3; (-) strand; PAM type: YTN; PAM sequence: TTT
cagggatgggaccaggcggt

SEQ ID NO: 11641 - DNA, 20 bp, Artificial Sequence
  Description of Artificial Sequence: Synthetic oligonucleotide
  Target: ANGPTL3; (-) strand; PAM type: YTN; PAM sequence: TTT
tcagggatgggaccaggcgg

SEQ ID NO: 11642 - DNA, 20 bp, Artificial Sequence
  Description of Artificial Sequence: Synthetic oligonucleotide
  Target: ANGPTL3; (-) strand; PAM type: YTN; PAM sequence: CTA
aggaagtagaagttttcagg

SEQ ID NO: 11643 - DNA, 20 bp, Artificial Sequence
  Description of Artificial Sequence: Synthetic oligonucleotide
  Target: ANGPTL3; (-) strand; PAM type: YTN; PAM sequence: TTA
aataaaggtgagtgtgcagg

SEQ ID NO: 11644 - DNA, 20 bp, Artificial Sequence
  Description of Artificial Sequence: Synthetic oligonucleotide
  Target: ANGPTL3; (-) strand; PAM type: YTN; PAM sequence: TTA
tgttaaataaaggtgagtgt

SEQ ID NO: 11645 - DNA, 20 bp, Artificial Sequence
  Description of Artificial Sequence: Synthetic oligonucleotide
  Target: ANGPTL3; (-) strand; PAM type: YTN; PAM sequence: TTA
tgttatgttaaataaaggtg

SEQ ID NO: 11646 - DNA, 20 bp, Artificial Sequence
  Description of Artificial Sequence: Synthetic oligonucleotide
  Target: ANGPTL3; (-) strand; PAM type: YTN; PAM sequence: TTT
atgttatgttaaataaaggt

SEQ ID NO: 11647 - DNA, 20 bp, Artificial Sequence
  Description of Artificial Sequence: Synthetic oligonucleotide
  Target: ANGPTL3; (-) strand; PAM type: YTN; PAM sequence: CTA
aaatttatgttatgttaaat

SEQ ID NO: 11648 - DNA, 20 bp, Artificial Sequence
  Description of Artificial Sequence: Synthetic oligonucleotide
  Target: ANGPTL3; (-) strand; PAM type: YTN; PAM sequence: TTA
gtgcaggaatagaagagata

SEQ ID NO: 11649 - DNA, 20 bp, Artificial Sequence
  Description of Artificial Sequence: Synthetic oligonucleotide
  Target: ANGPTL3; (-) strand; PAM type: YTN; PAM sequence: TTT
agtgcaggaatagaagagat

SEQ ID NO: 11650 - DNA, 20 bp, Artificial Sequence
  Description of Artificial Sequence: Synthetic oligonucleotide
  Target: ANGPTL3; (-) strand; PAM type: YTN; PAM sequence: TTT
tagtgcaggaatagaagaga

SEQ ID NO: 11651 - DNA, 20 bp, Artificial Sequence
  Description of Artificial Sequence: Synthetic oligonucleotide
  Target: ANGPTL3; (-) strand; PAM type: YTN; PAM sequence: TTA
cattttagtgcaggaataga

SEQ ID NO: 11652 - DNA, 20 bp, Artificial Sequence
  Description of Artificial Sequence: Synthetic oligonucleotide
  Target: ANGPTL3; (-) strand; PAM type: YTN; PAM sequence: CTT
acattttagtgcaggaatag

SEQ ID NO: 11653 - DNA, 20 bp, Artificial Sequence
  Description of Artificial Sequence: Synthetic oligonucleotide
  Target: ANGPTL3; (-) strand; PAM type: YTN; PAM sequence: TTC
acagagcttacattttagtg

SEQ ID NO: 11654 - DNA, 20 bp, Artificial Sequence
  Description of Artificial Sequence: Synthetic oligonucleotide
  Target: ANGPTL3; (-) strand; PAM type: YTN; PAM sequence: CTG
tattcacagagcttacattt

SEQ ID NO: 11655 - DNA, 20 bp, Artificial Sequence
  Description of Artificial Sequence: Synthetic oligonucleotide
  Target: ANGPTL3; (-) strand; PAM type: YTN; PAM sequence: CTG
gagtatatacaaataatgga

SEQ ID NO: 11656 - DNA, 20 bp, Artificial Sequence
  Description of Artificial Sequence: Synthetic oligonucleotide
  Target: ANGPTL3; (-) strand; PAM type: YTN; PAM sequence: TTC
tggagtatatacaaataatg

SEQ ID NO: 11657 - DNA, 20 bp, Artificial Sequence
  Description of Artificial Sequence: Synthetic oligonucleotide
  Target: ANGPTL3; (-) strand; PAM type: YTN; PAM sequence: CTA
tattctggagtatatacaaa

SEQ ID NO: 11658 - DNA, 20 bp, Artificial Sequence
  Description of Artificial Sequence: Synthetic oligonucleotide
  Target: ANGPTL3; (-) strand; PAM type: YTN; PAM sequence: TTC
tatattctggagtatataca

SEQ ID NO: 11659 - DNA, 20 bp, Artificial Sequence
  Description of Artificial Sequence: Synthetic oligonucleotide
  Target: ANGPTL3; (-) strand; PAM type: YTN; PAM sequence: CTG
tgtgccatacagtattctat

SEQ ID NO: 11660 - DNA, 20 bp, Artificial Sequence
  Description of Artificial Sequence: Synthetic oligonucleotide
  Target: ANGPTL3; (-) strand; PAM type: YTN; PAM sequence: CTA
ctgtgtgccatacagtattc

SEQ ID NO: 11661 - DNA, 20 bp, Artificial Sequence
  Description of Artificial Sequence: Synthetic oligonucleotide
  Target: ANGPTL3; (-) strand; PAM type: YTN; PAM sequence: TTC
aacagaaatgcctactgtgt

SEQ ID NO: 11662 - DNA, 20 bp, Artificial Sequence
  Description of Artificial Sequence: Synthetic oligonucleotide
  Target: ANGPTL3; (-) strand; PAM type: YTN; PAM sequence: TTA
attcaacagaaatgcctact

SEQ ID NO: 11663 - DNA, 20 bp, Artificial Sequence
  Description of Artificial Sequence: Synthetic oligonucleotide
  Target: ANGPTL3; (-) strand; PAM type: YTN; PAM sequence: TTA
ttaattcaacagaaatgcct

SEQ ID NO: 11664 - DNA, 20 bp, Artificial Sequence
  Description of Artificial Sequence: Synthetic oligonucleotide
  Target: ANGPTL3; (-) strand; PAM type: YTN; PAM sequence: TTT
attaattcaacagaaatgcc

SEQ ID NO: 11665 - DNA, 20 bp, Artificial Sequence
  Description of Artificial Sequence: Synthetic oligonucleotide
  Target: ANGPTL3; (-) strand; PAM type: YTN; PAM sequence: TTA
catttattaattcaacagaa

SEQ ID NO: 11666 - DNA, 20 bp, Artificial Sequence
  Description of Artificial Sequence: Synthetic oligonucleotide
  Target: ANGPTL3; (-) strand; PAM type: YTN; PAM sequence: CTG
tgtgaatatgacattacatt

SEQ ID NO: 11667 - DNA, 20 bp, Artificial Sequence
  Description of Artificial Sequence: Synthetic oligonucleotide
  Target: ANGPTL3; (-) strand; PAM type: YTN; PAM sequence: TTC
tgtgtgaatatgacattaca

SEQ ID NO: 11668 - DNA, 20 bp, Artificial Sequence
  Description of Artificial Sequence: Synthetic oligonucleotide
  Target: ANGPTL3; (-) strand; PAM type: YTN; PAM sequence: CTT
ctgtgtgaatatgacattac

SEQ ID NO: 11669 - DNA, 20 bp, Artificial Sequence
  Description of Artificial Sequence: Synthetic oligonucleotide
  Target: ANGPTL3; (-) strand; PAM type: YTN; PAM sequence: CTA
gtaatccaagtaataataat

SEQ ID NO: 11670 - DNA, 20 bp, Artificial Sequence
  Description of Artificial Sequence: Synthetic oligonucleotide
  Target: ANGPTL3; (-) strand; PAM type: YTN; PAM sequence: TTC
tagtaatccaagtaataata

SEQ ID NO: 11671 - DNA, 20 bp, Artificial Sequence
  Description of Artificial Sequence: Synthetic oligonucleotide
  Target: ANGPTL3; (-) strand; PAM type: YTN; PAM sequence: TTT
ctagtaatccaagtaataat

SEQ ID NO: 11672 - DNA, 20 bp, Artificial Sequence
  Description of Artificial Sequence: Synthetic oligonucleotide
  Target: ANGPTL3; (-) strand; PAM type: YTN; PAM sequence: CTA
tttctagtaatccaagtaat

SEQ ID NO: 11673 - DNA, 20 bp, Artificial Sequence
  Description of Artificial Sequence: Synthetic oligonucleotide
  Target: ANGPTL3; (-) strand; PAM type: YTN; PAM sequence: TTA
tgaggcacactatttctagt

SEQ ID NO: 11674 - DNA, 20 bp, Artificial Sequence
  Description of Artificial Sequence: Synthetic oligonucleotide
  Target: ANGPTL3; (-) strand; PAM type: YTN; PAM sequence: TTA
attatgaggcacactatttc

SEQ ID NO: 11675 - DNA, 20 bp, Artificial Sequence
  Description of Artificial Sequence: Synthetic oligonucleotide
  Target: ANGPTL3; (-) strand; PAM type: YTN; PAM sequence: TTT
aattatgaggcacactattt

SEQ ID NO: 11676 - DNA, 20 bp, Artificial Sequence
  Description of Artificial Sequence: Synthetic oligonucleotide
  Target: ANGPTL3; (-) strand; PAM type: YTN; PAM sequence: CTT
taattatgaggcacactatt

SEQ ID NO: 11677 - DNA, 20 bp, Artificial Sequence
  Description of Artificial Sequence: Synthetic oligonucleotide
  Target: ANGPTL3; (-) strand; PAM type: YTN; PAM sequence: TTG
acctttaattatgaggcaca

SEQ ID NO: 11678 - DNA, 20 bp, Artificial Sequence
  Description of Artificial Sequence: Synthetic oligonucleotide
  Target: ANGPTL3; (-) strand; PAM type: YTN; PAM sequence: TTG
aatgttgacctttaattatg

SEQ ID NO: 11679 - DNA, 20 bp, Artificial Sequence
  Description of Artificial Sequence: Synthetic oligonucleotide
  Target: ANGPTL3; (-) strand; PAM type: YTN; PAM sequence: TTG
ttgaatgttgacctttaatt

SEQ ID NO: 11680 - DNA, 20 bp, Artificial Sequence
  Description of Artificial Sequence: Synthetic oligonucleotide
  Target: ANGPTL3; (-) strand; PAM type: YTN; PAM sequence: TTA
cattgttgaatgttgacctt

SEQ ID NO: 11681 - DNA, 20 bp, Artificial Sequence
  Description of Artificial Sequence: Synthetic oligonucleotide
  Target: ANGPTL3; (-) strand; PAM type: YTN; PAM sequence: TTA
attacattgttgaatgttga

SEQ ID NO: 11682 - DNA, 20 bp, Artificial Sequence
  Description of Artificial Sequence: Synthetic oligonucleotide
  Target: ANGPTL3; (-) strand; PAM type: YTN; PAM sequence: TTG
tagattaattacattgttga

SEQ ID NO: 11683 - DNA, 20 bp, Artificial Sequence
  Description of Artificial Sequence: Synthetic oligonucleotide
  Target: ANGPTL3; (-) strand; PAM type: YTN; PAM sequence: TTA
cattgtagattaattacatt

SEQ ID NO: 11684 - DNA, 20 bp, Artificial Sequence
  Description of Artificial Sequence: Synthetic oligonucleotide
  Target: ANGPTL3; (-) strand; PAM type: YTN; PAM sequence: TTT
acattgtagattaattacat

SEQ ID NO: 11685 - DNA, 20 bp, Artificial Sequence
  Description of Artificial Sequence: Synthetic oligonucleotide
  Target: ANGPTL3; (-) strand; PAM type: YTN; PAM sequence: TTC
accagatgtttacattgtag

SEQ ID NO: 11686 - DNA, 20 bp, Artificial Sequence
  Description of Artificial Sequence: Synthetic oligonucleotide
  Target: ANGPTL3; (-) strand; PAM type: YTN; PAM sequence: CTT
caccagatgtttacattgta

SEQ ID NO: 11687 - DNA, 20 bp, Artificial Sequence
  Description of Artificial Sequence: Synthetic oligonucleotide
  Target: ANGPTL3; (-) strand; PAM type: YTN; PAM sequence: CTG
tcacttcaccagatgtttac

SEQ ID NO: 11688 - DNA, 20 bp, Artificial Sequence
  Description of Artificial Sequence: Synthetic oligonucleotide
  Target: ANGPTL3; (-) strand; PAM type: YTN; PAM sequence: CTC
tgtcacttcaccagatgttt

SEQ ID NO: 11689 - DNA, 20 bp, Artificial Sequence
  Description of Artificial Sequence: Synthetic oligonucleotide
  Target: ANGPTL3; (-) strand; PAM type: YTN; PAM sequence: TTC
cctctgtcacttcaccagat

SEQ ID NO: 11690 - DNA, 20 bp, Artificial Sequence
  Description of Artificial Sequence: Synthetic oligonucleotide
  Target: ANGPTL3; (-) strand; PAM type: YTN; PAM sequence: CTT
ccctctgtcacttcaccaga

SEQ ID NO: 11691 - DNA, 20 bp, Artificial Sequence
  Description of Artificial Sequence: Synthetic oligonucleotide
  Target: ANGPTL3; (-) strand; PAM type: YTN; PAM sequence: CTA
aacaagtgcttccctctgtc

SEQ ID NO: 11692 - DNA, 20 bp, Artificial Sequence
  Description of Artificial Sequence: Synthetic oligonucleotide
  Target: ANGPTL3; (-) strand; PAM type: YTN; PAM sequence: TTC
taaacaagtgcttccctctg

SEQ ID NO: 11693 - DNA, 20 bp, Artificial Sequence
  Description of Artificial Sequence: Synthetic oligonucleotide
  Target: ANGPTL3; (-) strand; PAM type: YTN; PAM sequence: TTT
ctaaacaagtgcttccctct

SEQ ID NO: 11694 - DNA, 20 bp, Artificial Sequence
  Description of Artificial Sequence: Synthetic oligonucleotide
  Target: ANGPTL3; (-) strand; PAM type: YTN; PAM sequence: TTT
tctaaacaagtgcttccctc

SEQ ID NO: 11695 - DNA, 20 bp, Artificial Sequence
  Description of Artificial Sequence: Synthetic oligonucleotide
  Target: ANGPTL3; (-) strand; PAM type: YTN; PAM sequence: TTT
ttctaaacaagtgcttccct

SEQ ID NO: 11696 - DNA, 20 bp, Artificial Sequence
  Description of Artificial Sequence: Synthetic oligonucleotide
  Target: ANGPTL3; (-) strand; PAM type: YTN; PAM sequence: TTT
tttctaaacaagtgcttccc

SEQ ID NO: 11697 - DNA, 20 bp, Artificial Sequence
  Description of Artificial Sequence: Synthetic oligonucleotide
  Target: ANGPTL3; (-) strand; PAM type: YTN; PAM sequence: CTT
ttttctaaacaagtgcttcc

SEQ ID NO: 11698 - DNA, 20 bp, Artificial Sequence
  Description of Artificial Sequence: Synthetic oligonucleotide
  Target: ANGPTL3; (-) strand; PAM type: YTN; PAM sequence: CTG
acatagcttttttctaaaca

SEQ ID NO: 11699 - DNA, 20 bp, Artificial Sequence
  Description of Artificial Sequence: Synthetic oligonucleotide
  Target: ANGPTL3; (-) strand; PAM type: YTN; PAM sequence: TTC
tgacatagcttttttctaaa

SEQ ID NO: 11700 - DNA, 20 bp, Artificial Sequence
  Description of Artificial Sequence: Synthetic oligonucleotide
  Target: ANGPTL3; (-) strand; PAM type: YTN; PAM sequence: TTA
gaatacatggattctgacat

SEQ ID NO: 11701 - DNA, 20 bp, Artificial Sequence
  Description of Artificial Sequence: Synthetic oligonucleotide
  Target: ANGPTL3; (-) strand; PAM type: YTN; PAM sequence: CTG
catattagaatacatggatt

SEQ ID NO: 11702 - DNA, 20 bp, Artificial Sequence
  Description of Artificial Sequence: Synthetic oligonucleotide
  Target: ANGPTL3; (-) strand; PAM type: YTN; PAM sequence: TTG
tactgcatattagaatacat

SEQ ID NO: 11703 - DNA, 20 bp, Artificial Sequence
  Description of Artificial Sequence: Synthetic oligonucleotide
  Target: ANGPTL3; (-) strand; PAM type: YTN; PAM sequence: CTA
ttgtactgcatattagaata

SEQ ID NO: 11704 - DNA, 20 bp, Artificial Sequence
  Description of Artificial Sequence: Synthetic oligonucleotide
  Target: ANGPTL3; (-) strand; PAM type: YTN; PAM sequence: TTA
aactattgtactgcatatta

SEQ ID NO: 11705 - DNA, 20 bp, Artificial Sequence
  Description of Artificial Sequence: Synthetic oligonucleotide
  Target: ANGPTL3; (-) strand; PAM type: YTN; PAM sequence: TTT
aaactattgtactgcatatt

SEQ ID NO: 11706 - DNA, 20 bp, Artificial Sequence
  Description of Artificial Sequence: Synthetic oligonucleotide
  Target: ANGPTL3; (-) strand; PAM type: YTN; PAM sequence: TTT
taaactattgtactgcatat

SEQ ID NO: 11707 - DNA, 20 bp, Artificial Sequence
  Description of Artificial Sequence: Synthetic oligonucleotide
  Target: ANGPTL3; (-) strand; PAM type: YTN; PAM sequence: TTT
ttaaactattgtactgcata

SEQ ID NO: 11708 - DNA, 20 bp, Artificial Sequence
  Description of Artificial Sequence: Synthetic oligonucleotide
  Target: ANGPTL3; (-) strand; PAM type: YTN; PAM sequence: TTA
atatttttaaactattgtac

SEQ ID NO: 11709 - DNA, 20 bp, Artificial Sequence
  Description of Artificial Sequence: Synthetic oligonucleotide
  Target: ANGPTL3; (-) strand; PAM type: YTN; PAM sequence: TTA
ttaatatttttaaactattg

SEQ ID NO: 11710 - DNA, 20 bp, Artificial Sequence
  Description of Artificial Sequence: Synthetic oligonucleotide
  Target: ANGPTL3; (-) strand; PAM type: YTN; PAM sequence: TTG
agagtattattaatattttt

SEQ ID NO: 11711 - DNA, 20 bp, Artificial Sequence
  Description of Artificial Sequence: Synthetic oligonucleotide
  Target: ANGPTL3; (-) strand; PAM type: YTN; PAM sequence: TTT
gagagtattattaatatttt

SEQ ID NO: 11712 - DNA, 20 bp, Artificial Sequence
  Description of Artificial Sequence: Synthetic oligonucleotide
  Target: ANGPTL3; (-) strand; PAM type: YTN; PAM sequence: CTG
tttgagagtattattaatat

SEQ ID NO: 11713 - DNA, 20 bp, Artificial Sequence
  Description of Artificial Sequence: Synthetic oligonucleotide
  Target: ANGPTL3; (-) strand; PAM type: YTN; PAM sequence: TTG
aatagctgtttgagagtatt

SEQ ID NO: 11714 - DNA, 20 bp, Artificial Sequence
  Description of Artificial Sequence: Synthetic oligonucleotide
  Target: ANGPTL3; (-) strand; PAM type: YTN; PAM sequence: CTT
gaatagctgtttgagagtat

SEQ ID NO: 11715 - DNA, 20 bp, Artificial Sequence
  Description of Artificial Sequence: Synthetic oligonucleotide
  Target: ANGPTL3; (-) strand; PAM type: YTN; PAM sequence: CTC
ttgaatagctgtttgagagt

SEQ ID NO: 11716 - DNA, 20 bp, Artificial Sequence
  Description of Artificial Sequence: Synthetic oligonucleotide
  Target: ANGPTL3; (-) strand; PAM type: YTN; PAM sequence: TTG
aatcctcttgaatagctgtt

SEQ ID NO: 11717 - DNA, 20 bp, Artificial Sequence
  Description of Artificial Sequence: Synthetic oligonucleotide
  Target: ANGPTL3; (-) strand; PAM type: YTN; PAM sequence: TTT
gaatcctcttgaatagctgt

SEQ ID NO: 11718 - DNA, 20 bp, Artificial Sequence
  Description of Artificial Sequence: Synthetic oligonucleotide
  Target: ANGPTL3; (-) strand; PAM type: YTN; PAM sequence: TTT
tgaatcctcttgaatagctg

SEQ ID NO: 11719 - DNA, 20 bp, Artificial Sequence
  Description of Artificial Sequence: Synthetic oligonucleotide
  Target: ANGPTL3; (-) strand; PAM type: YTN; PAM sequence: TTT
ttgaatcctcttgaatagct

SEQ ID NO: 11720 - DNA, 20 bp, Artificial Sequence
  Description of Artificial Sequence: Synthetic oligonucleotide
  Target: ANGPTL3; (-) strand; PAM type: YTN; PAM sequence: TTT
tttgaatcctcttgaatagc

SEQ ID NO: 11721 - DNA, 20 bp, Artificial Sequence
  Description of Artificial Sequence: Synthetic oligonucleotide
  Target: ANGPTL3; (-) strand; PAM type: YTN; PAM sequence: TTA
tgttttttgaatcctcttga

SEQ ID NO: 11722 - DNA, 20 bp, Artificial Sequence
  Description of Artificial Sequence: Synthetic oligonucleotide
  Target: ANGPTL3; (-) strand; PAM type: YTN; PAM sequence: TTA
tattatgttttttgaatcct

SEQ ID NO: 11723 - DNA, 20 bp, Artificial Sequence
  Description of Artificial Sequence: Synthetic oligonucleotide
  Target: ANGPTL3; (-) strand; PAM type: YTN; PAM sequence: TTT
atattatgttttttgaatcc

SEQ ID NO: 11724 - DNA, 20 bp, Artificial Sequence
  Description of Artificial Sequence: Synthetic oligonucleotide
  Target: ANGPTL3; (-) strand; PAM type: YTN; PAM sequence: CTG
agtttatattatgttttttg

SEQ ID NO: 11725 - DNA, 20 bp, Artificial Sequence
  Description of Artificial Sequence: Synthetic oligonucleotide
  Target: ANGPTL3; (-) strand; PAM type: YTN; PAM sequence: CTC
tgagtttatattatgttttt

SEQ ID NO: 11726 - DNA, 20 bp, Artificial Sequence
  Description of Artificial Sequence: Synthetic oligonucleotide
  Target: ANGPTL3; (-) strand; PAM type: YTN; PAM sequence: TTC
tctgagtttatattatgttt

SEQ ID NO: 11727 - DNA, 20 bp, Artificial Sequence
  Description of Artificial Sequence: Synthetic oligonucleotide
  Target: ANGPTL3; (-) strand; PAM type: YTN; PAM sequence: TTT
ctctgagtttatattatgtt

SEQ ID NO: 11728 - DNA, 20 bp, Artificial Sequence
  Description of Artificial Sequence: Synthetic oligonucleotide
  Target: ANGPTL3; (-) strand; PAM type: YTN; PAM sequence: TTA
ccagtttctctgagtttata

SEQ ID NO: 11729 - DNA, 20 bp, Artificial Sequence
  Description of Artificial Sequence: Synthetic oligonucleotide
  Target: ANGPTL3; (-) strand; PAM type: YTN; PAM sequence: TTT
accagtttctctgagtttat

SEQ ID NO: 11730 - DNA, 20 bp, Artificial Sequence
  Description of Artificial Sequence: Synthetic oligonucleotide
  Target: ANGPTL3; (-) strand; PAM type: YTN; PAM sequence: TTG
tttaccagtttctctgagtt

SEQ ID NO: 11731 - DNA, 20 bp, Artificial Sequence
  Description of Artificial Sequence: Synthetic oligonucleotide
  Target: ANGPTL3; (-) strand; PAM type: YTN; PAM sequence: TTT
gtttaccagtttctctgagt

SEQ ID NO: 11732 - DNA, 20 bp, Artificial Sequence
  Description of Artificial Sequence: Synthetic oligonucleotide
  Target: ANGPTL3; (-) strand; PAM type: YTN; PAM sequence: TTT
tgtttaccagtttctctgag

SEQ ID NO: 11733 - DNA, 20 bp, Artificial Sequence
  Description of Artificial Sequence: Synthetic oligonucleotide
  Target: ANGPTL3; (-) strand; PAM type: YTN; PAM sequence: TTG
aaaatgattttgtttaccag

SEQ ID NO: 11734 - DNA, 20 bp, Artificial Sequence
  Description of Artificial Sequence: Synthetic oligonucleotide
  Target: ANGPTL3; (-) strand; PAM type: YTN; PAM sequence: CTT
gaaaatgattttgtttacca

SEQ ID NO: 11735 - DNA, 20 bp, Artificial Sequence
  Description of Artificial Sequence: Synthetic oligonucleotide
  Target: ANGPTL3; (-) strand; PAM type: YTN; PAM sequence: CTC
ttgaaaatgattttgtttac

SEQ ID NO: 11736 - DNA, 20 bp, Artificial Sequence
  Description of Artificial Sequence: Synthetic oligonucleotide
  Target: ANGPTL3; (-) strand; PAM type: YTN; PAM sequence: TTA
tatctcttgaaaatgatttt

SEQ ID NO: 11737 - DNA, 20 bp, Artificial Sequence
  Description of Artificial Sequence: Synthetic oligonucleotide
  Target: ANGPTL3; (-) strand; PAM type: YTN; PAM sequence: TTT
atatctcttgaaaatgattt

SEQ ID NO: 11738 - DNA, 20 bp, Artificial Sequence
  Description of Artificial Sequence: Synthetic oligonucleotide
  Target: ANGPTL3; (-) strand; PAM type: YTN; PAM sequence: TTT
tatatctcttgaaaatgatt

SEQ ID NO: 11739 - DNA, 20 bp, Artificial Sequence
  Description of Artificial Sequence: Synthetic oligonucleotide
  Target: ANGPTL3; (-) strand; PAM type: YTN; PAM sequence: TTG
ttttatatctcttgaaaatg

SEQ ID NO: 11740 - DNA, 20 bp, Artificial Sequence
  Description of Artificial Sequence: Synthetic oligonucleotide
  Target: ANGPTL3; (-) strand; PAM type: YTN; PAM sequence: TTT
gttttatatctcttgaaaat

SEQ ID NO: 11741 - DNA, 20 bp, Artificial Sequence
  Description of Artificial Sequence: Synthetic oligonucleotide
  Target: ANGPTL3; (-) strand; PAM type: YTN; PAM sequence: TTG
gtaataatatttgttttata

SEQ ID NO: 11742 - DNA, 20 bp, Artificial Sequence
  Description of Artificial Sequence: Synthetic oligonucleotide
  Target: ANGPTL3; (-) strand; PAM type: YTN; PAM sequence: TTA
gtggaaattggtaataatat

SEQ ID NO: 11743 - DNA, 20 bp, Artificial Sequence
  Description of Artificial Sequence: Synthetic oligonucleotide
  Target: ANGPTL3; (-) strand; PAM type: YTN; PAM sequence: TTT
agtggaaattggtaataata

SEQ ID NO: 11744 - DNA, 20 bp, Artificial Sequence
  Description of Artificial Sequence: Synthetic oligonucleotide
  Target: ANGPTL3; (-) strand; PAM type: YTN; PAM sequence: TTG
tttagtggaaattggtaata

SEQ ID NO: 11745 - DNA, 20 bp, Artificial Sequence
  Description of Artificial Sequence: Synthetic oligonucleotide
  Target: ANGPTL3; (-) strand; PAM type: YTN; PAM sequence: TTT
gtttagtggaaattggtaat

SEQ ID NO: 11746 - DNA, 20 bp, Artificial Sequence
  Description of Artificial Sequence: Synthetic oligonucleotide
  Target: ANGPTL3; (-) strand; PAM type: YTN; PAM sequence: TTA
tgtttgtttagtggaaattg

SEQ ID NO: 11747 - DNA, 20 bp, Artificial Sequence
  Description of Artificial Sequence: Synthetic oligonucleotide
  Target: ANGPTL3; (-) strand; PAM type: YTN; PAM sequence: CTA
acattatgtttgtttagtgg

SEQ ID NO: 11748 - DNA, 20 bp, Artificial Sequence
  Description of Artificial Sequence: Synthetic oligonucleotide
  Target: ANGPTL3; (-) strand; PAM type: YTN; PAM sequence: CTA
ctaacattatgtttgtttag

SEQ ID NO: 11749 - DNA, 20 bp, Artificial Sequence
  Description of Artificial Sequence: Synthetic oligonucleotide
  Target: ANGPTL3; (-) strand; PAM type: YTN; PAM sequence: TTA
gcagcactactaacattatg

SEQ ID NO: 11750 - DNA, 20 bp, Artificial Sequence
  Description of Artificial Sequence: Synthetic oligonucleotide
  Target: ANGPTL3; (-) strand; PAM type: YTN; PAM sequence: TTT
agcagcactactaacattat

SEQ ID NO: 11751 - DNA, 20 bp, Artificial Sequence
  Description of Artificial Sequence: Synthetic oligonucleotide
  Target: ANGPTL3; (-) strand; PAM type: YTN; PAM sequence: TTT
tagcagcactactaacatta

SEQ ID NO: 11752 - DNA, 20 bp, Artificial Sequence
  Description of Artificial Sequence: Synthetic oligonucleotide
  Target: ANGPTL3; (-) strand; PAM type: YTN; PAM sequence: CTT
ttagcagcactactaacatt

SEQ ID NO: 11753 - DNA, 20 bp, Artificial Sequence
  Description of Artificial Sequence: Synthetic oligonucleotide
  Target: ANGPTL3; (-) strand; PAM type: YTN; PAM sequence: TTG
ataaaaaaccttttagcagc

SEQ ID NO: 11754 - DNA, 20 bp, Artificial Sequence
  Description of Artificial Sequence: Synthetic oligonucleotide
  Target: ANGPTL3; (-) strand; PAM type: YTN; PAM sequence: TTA
gaataataacatcataagaa

SEQ ID NO: 11755 - DNA, 20 bp, Artificial Sequence
  Description of Artificial Sequence: Synthetic oligonucleotide
  Target: ANGPTL3; (-) strand; PAM type: YTN; PAM sequence: TTT
agaataataacatcataaga

SEQ ID NO: 11756 - DNA, 20 bp, Artificial Sequence
  Description of Artificial Sequence: Synthetic oligonucleotide
  Target: ANGPTL3; (-) strand; PAM type: YTN; PAM sequence: TTG
aaaagaatttagaataataa

SEQ ID NO: 11757 - DNA, 20 bp, Artificial Sequence
  Description of Artificial Sequence: Synthetic oligonucleotide
  Target: ANGPTL3; (-) strand; PAM type: YTN; PAM sequence: TTA
atcatagtaaaagatataat

SEQ ID NO: 11758 - DNA, 20 bp, Artificial Sequence
  Description of Artificial Sequence: Synthetic oligonucleotide
  Target: ANGPTL3; (-) strand; PAM type: YTN; PAM sequence: TTT
aatcatagtaaaagatataa

SEQ ID NO: 11759 - DNA, 20 bp, Artificial Sequence
  Description of Artificial Sequence: Synthetic oligonucleotide
  Target: ANGPTL3; (-) strand; PAM type: YTN; PAM sequence: TTC
atttaatcatagtaaaagat

SEQ ID NO: 11760 - DNA, 20 bp, Artificial Sequence
  Description of Artificial Sequence: Synthetic oligonucleotide
  Target: ANGPTL3; (-) strand; PAM type: YTN; PAM sequence: TTG
gggagcaggttcatttaatc

SEQ ID NO: 11761 - DNA, 20 bp, Artificial Sequence
  Description of Artificial Sequence: Synthetic oligonucleotide
  Target: ANGPTL3; (-) strand; PAM type: YTN; PAM sequence: TTT
ggggagcaggttcatttaat

SEQ ID NO: 11762 - DNA, 20 bp, Artificial Sequence
  Description of Artificial Sequence: Synthetic oligonucleotide
  Target: ANGPTL3; (-) strand; PAM type: YTN; PAM sequence: CTT
tggggagcaggttcatttaa

SEQ ID NO: 11763 - DNA, 20 bp, Artificial Sequence
  Description of Artificial Sequence: Synthetic oligonucleotide
  Target: ANGPTL3; (-) strand; PAM type: YTN; PAM sequence: TTG
ctttggggagcaggttcatt

SEQ ID NO: 11764 - DNA, 20 bp, Artificial Sequence
  Description of Artificial Sequence: Synthetic oligonucleotide
  Target: ANGPTL3; (-) strand; PAM type: YTN; PAM sequence: TTT
gctttggggagcaggttcat

SEQ ID NO: 11765 - DNA, 20 bp, Artificial Sequence
  Description of Artificial Sequence: Synthetic oligonucleotide
  Target: ANGPTL3; (-) strand; PAM type: YTN; PAM sequence: TTT
tgctttggggagcaggttca

SEQ ID NO: 11766 - DNA, 20 bp, Artificial Sequence
  Description of Artificial Sequence: Synthetic oligonucleotide
  Target: ANGPTL3; (-) strand; PAM type: YTN; PAM sequence: CTA
tagtaacattttgctttggg

SEQ ID NO: 11767 - DNA, 20 bp, Artificial Sequence
  Description of Artificial Sequence: Synthetic oligonucleotide
  Target: ANGPTL3; (-) strand; PAM type: YTN; PAM sequence: TTA
ctatagtaacattttgcttt

SEQ ID NO: 11768 - DNA, 20 bp, Artificial Sequence
  Description of Artificial Sequence: Synthetic oligonucleotide
  Target: ANGPTL3; (-) strand; PAM type: YTN; PAM sequence: TTA
gacacaatgtatattactat

SEQ ID NO: 11769 - DNA, 20 bp, Artificial Sequence
  Description of Artificial Sequence: Synthetic oligonucleotide
  Target: ANGPTL3; (-) strand; PAM type: YTN; PAM sequence: TTT
agacacaatgtatattacta

SEQ ID NO: 11770 - DNA, 20 bp, Artificial Sequence
  Description of Artificial Sequence: Synthetic oligonucleotide
  Target: ANGPTL3; (-) strand; PAM type: YTN; PAM sequence: TTT
tagacacaatgtatattact

SEQ ID NO: 11771 - DNA, 20 bp, Artificial Sequence
  Description of Artificial Sequence: Synthetic oligonucleotide
  Target: ANGPTL3; (-) strand; PAM type: YTN; PAM sequence: TTT
ttagacacaatgtatattac

SEQ ID NO: 11772 - DNA, 20 bp, Artificial Sequence
  Description of Artificial Sequence: Synthetic oligonucleotide
  Target: ANGPTL3; (-) strand; PAM type: YTN; PAM sequence: TTA
tttttagacacaatgtatat

SEQ ID NO: 11773 - DNA, 20 bp, Artificial Sequence
  Description of Artificial Sequence: Synthetic oligonucleotide
  Target: ANGPTL3; (-) strand; PAM type: YTN; PAM sequence: TTT
atttttagacacaatgtata

SEQ ID NO: 11774 - DNA, 20 bp, Artificial Sequence
  Description of Artificial Sequence: Synthetic oligonucleotide
  Target: ANGPTL3; (-) strand; PAM type: YTN; PAM sequence: TTT
tatttttagacacaatgtat

SEQ ID NO: 11775 - DNA, 20 bp, Artificial Sequence
  Description of Artificial Sequence: Synthetic oligonucleotide
  Target: ANGPTL3; (-) strand; PAM type: YTN; PAM sequence: TTT
ttatttttagacacaatgta

SEQ ID NO: 11776 - DNA, 20 bp, Artificial Sequence
  Description of Artificial Sequence: Synthetic oligonucleotide
  Target: ANGPTL3; (-) strand; PAM type: YTN; PAM sequence: TTC
acacatttttatttttagac

SEQ ID NO: 11777 - DNA, 20 bp, Artificial Sequence
  Description of Artificial Sequence: Synthetic oligonucleotide
  Target: ANGPTL3; (-) strand; PAM type: YTN; PAM sequence: CTT
cacacatttttatttttaga

SEQ ID NO: 11778 - DNA, 20 bp, Artificial Sequence
  Description of Artificial Sequence: Synthetic oligonucleotide
  Target: ANGPTL3; (-) strand; PAM type: YTN; PAM sequence: TTC
ttcacacatttttattttta

SEQ ID NO: 11779 - DNA, 20 bp, Artificial Sequence
  Description of Artificial Sequence: Synthetic oligonucleotide
  Target: ANGPTL3; (-) strand; PAM type: YTN; PAM sequence: TTT
cttcacacatttttattttt

SEQ ID NO: 11780 - DNA, 20 bp, Artificial Sequence
  Description of Artificial Sequence: Synthetic oligonucleotide
  Target: ANGPTL3; (-) strand; PAM type: YTN; PAM sequence: TTG
gtttcttcacacatttttat

SEQ ID NO: 11781 - DNA, 20 bp, Artificial Sequence
  Description of Artificial Sequence: Synthetic oligonucleotide
  Target: ANGPTL3; (-) strand; PAM type: YTN; PAM sequence: TTT
ggtttcttcacacattttta

SEQ ID NO: 11782 - DNA, 20 bp, Artificial Sequence
  Description of Artificial Sequence: Synthetic oligonucleotide
  Target: ANGPTL3; (-) strand; PAM type: YTN; PAM sequence: TTT
tggtttcttcacacattttt

SEQ ID NO: 11783 - DNA, 20 bp, Artificial Sequence
  Description of Artificial Sequence: Synthetic oligonucleotide
  Target: ANGPTL3; (-) strand; PAM type: YTN; PAM sequence: TTG
ttttggtttcttcacacatt

SEQ ID NO: 11784 - DNA, 20 bp, Artificial Sequence
  Description of Artificial Sequence: Synthetic oligonucleotide
  Target: ANGPTL3; (-) strand; PAM type: YTN; PAM sequence: TTC
attgttttggtttcttcaca

SEQ ID NO: 11785 - DNA, 20 bp, Artificial Sequence
  Description of Artificial Sequence: Synthetic oligonucleotide
  Target: ANGPTL3; (-) strand; PAM type: YTN; PAM sequence: CTC
agaaattcattgttttggtt

SEQ ID NO: 11786 - DNA, 20 bp, Artificial Sequence
  Description of Artificial Sequence: Synthetic oligonucleotide
  Target: ANGPTL3; (-) strand; PAM type: YTN; PAM sequence: TTC
caactcagaaattcattgtt

SEQ ID NO: 11787 - DNA, 20 bp, Artificial Sequence
  Description of Artificial Sequence: Synthetic oligonucleotide
  Target: ANGPTL3; (-) strand; PAM type: YTN; PAM sequence: CTT
ccaactcagaaattcattgt

SEQ ID NO: 11788 - DNA, 20 bp, Artificial Sequence
  Description of Artificial Sequence: Synthetic oligonucleotide
  Target: ANGPTL3; (-) strand; PAM type: YTN; PAM sequence: TTC
ttccaactcagaaattcatt

SEQ ID NO: 11789 - DNA, 20 bp, Artificial Sequence
  Description of Artificial Sequence: Synthetic oligonucleotide
  Target: ANGPTL3; (-) strand; PAM type: YTN; PAM sequence: CTT
cttccaactcagaaattcat

SEQ ID NO: 11790 - DNA, 20 bp, Artificial Sequence
  Description of Artificial Sequence: Synthetic oligonucleotide
  Target: ANGPTL3; (-) strand; PAM type: YTN; PAM sequence: CTC
ttcttccaactcagaaattc

SEQ ID NO: 11791 - DNA, 20 bp, Artificial Sequence
  Description of Artificial Sequence: Synthetic oligonucleotide
  Target: ANGPTL3; (-) strand; PAM type: YTN; PAM sequence: CTA
actcttcttccaactcagaa

SEQ ID NO: 11792 - DNA, 20 bp, Artificial Sequence
  Description of Artificial Sequence: Synthetic oligonucleotide
  Target: ANGPTL3; (-) strand; PAM type: YTN; PAM sequence: TTA
aatgatctaactcttcttcc

SEQ ID NO: 11793 - DNA, 20 bp, Artificial Sequence
  Description of Artificial Sequence: Synthetic oligonucleotide
  Target: ANGPTL3; (-) strand; PAM type: YTN; PAM sequence: TTA
aatatgagaaagttaaatga

SEQ ID NO: 11794 - DNA, 20 bp, Artificial Sequence
  Description of Artificial Sequence: Synthetic oligonucleotide
  Target: ANGPTL3; (-) strand; PAM type: YTN; PAM sequence: TTT
aaatatgagaaagttaaatg

SEQ ID NO: 11795 - DNA, 20 bp, Artificial Sequence
  Description of Artificial Sequence: Synthetic oligonucleotide
  Target: ANGPTL3; (-) strand; PAM type: YTN; PAM sequence: TTA
atttaaatatgagaaagtta

SEQ ID NO: 11796 - DNA, 20 bp, Artificial Sequence
  Description of Artificial Sequence: Synthetic oligonucleotide
  Target: ANGPTL3; (-) strand; PAM type: YTN; PAM sequence: TTT
aatttaaatatgagaaagtt

SEQ ID NO: 11797 - DNA, 20 bp, Artificial Sequence
  Description of Artificial Sequence: Synthetic oligonucleotide
  Target: ANGPTL3; (-) strand; PAM type: YTN; PAM sequence: TTT
taatttaaatatgagaaagt

SEQ ID NO: 11798 - DNA, 20 bp, Artificial Sequence
  Description of Artificial Sequence: Synthetic oligonucleotide
  Target: ANGPTL3; (-) strand; PAM type: YTN; PAM sequence: TTT
ttaatttaaatatgagaaag

SEQ ID NO: 11799 - DNA, 20 bp, Artificial Sequence
  Description of Artificial Sequence: Synthetic oligonucleotide
  Target: ANGPTL3; (-) strand; PAM type: YTN; PAM sequence: TTT
tttaatttaaatatgagaaa

SEQ ID NO: 11800 - DNA, 20 bp, Artificial Sequence
  Description of Artificial Sequence: Synthetic oligonucleotide
  Target: ANGPTL3; (-) strand; PAM type: YTN; PAM sequence: TTT
ttttaatttaaatatgagaa

SEQ ID NO: 11801 - DNA, 20 bp, Artificial Sequence
  Description of Artificial Sequence: Synthetic oligonucleotide
  Target: ANGPTL3; (-) strand; PAM type: YTN; PAM sequence: TTG
tttttttaatttaaatatga

SEQ ID NO: 11802 - DNA, 20 bp, Artificial Sequence
  Description of Artificial Sequence: Synthetic oligonucleotide
  Target: ANGPTL3; (-) strand; PAM type: YTN; PAM sequence: TTT
gtttttttaatttaaatatg

SEQ ID NO: 11803 - DNA, 20 bp, Artificial Sequence
  Description of Artificial Sequence: Synthetic oligonucleotide
  Target: ANGPTL3; (-) strand; PAM type: YTN; PAM sequence: TTT
tgtttttttaatttaaatat

SEQ ID NO: 11804 - DNA, 20 bp, Artificial Sequence
  Description of Artificial Sequence: Synthetic oligonucleotide
  Target: ANGPTL3; (-) strand; PAM type: YTN; PAM sequence: TTA
gagttttgtttttttaattt

SEQ ID NO: 11805 - DNA, 20 bp, Artificial Sequence
  Description of Artificial Sequence: Synthetic oligonucleotide
  Target: ANGPTL3; (-) strand; PAM type: YTN; PAM sequence: TTT
agagttttgtttttttaatt

SEQ ID NO: 11806 - DNA, 20 bp, Artificial Sequence
  Description of Artificial Sequence: Synthetic oligonucleotide
  Target: ANGPTL3; (-) strand; PAM type: YTN; PAM sequence: TTT
tagagttttgtttttttaat

SEQ ID NO: 11807 - DNA, 20 bp, Artificial Sequence
  Description of Artificial Sequence: Synthetic oligonucleotide
  Target: ANGPTL3; (-) strand; PAM type: YTN; PAM sequence: TTT
ttagagttttgtttttttaa

SEQ ID NO: 11808 - DNA, 20 bp, Artificial Sequence
  Description of Artificial Sequence: Synthetic oligonucleotide
  Target: ANGPTL3; (-) strand; PAM type: YTN; PAM sequence: TTA
aatttttagagttttgtttt

SEQ ID NO: 11809 - DNA, 20 bp, Artificial Sequence
  Description of Artificial Sequence: Synthetic oligonucleotide
  Target: ANGPTL3; (-) strand; PAM type: YTN; PAM sequence: CTT
aaatttttagagttttgttt

SEQ ID NO: 11810 - DNA, 20 bp, Artificial Sequence
  Description of Artificial Sequence: Synthetic oligonucleotide
  Target: ANGPTL3; (-) strand; PAM type: YTN; PAM sequence: TTA
cttaaatttttagagttttg

SEQ ID NO: 11811 - DNA, 20 bp, Artificial Sequence
  Description of Artificial Sequence: Synthetic oligonucleotide
  Target: ANGPTL3; (-) strand; PAM type: YTN; PAM sequence: TTA
aagttacttaaatttttaga

SEQ ID NO: 11812 - DNA, 20 bp, Artificial Sequence
  Description of Artificial Sequence: Synthetic oligonucleotide
  Target: ANGPTL3; (-) strand; PAM type: YTN; PAM sequence: CTT
aaagttacttaaatttttag

SEQ ID NO: 11813 - DNA, 20 bp, Artificial Sequence
  Description of Artificial Sequence: Synthetic oligonucleotide
  Target: ANGPTL3; (-) strand; PAM type: YTN; PAM sequence: CTA
tgtgatcttaaagttactta

SEQ ID NO: 11814 - DNA, 20 bp, Artificial Sequence
  Description of Artificial Sequence: Synthetic oligonucleotide
  Target: ANGPTL3; (-) strand; PAM type: YTN; PAM sequence: CTA
agtaactatgtgatcttaaa

SEQ ID NO: 11815 - DNA, 20 bp, Artificial Sequence
  Description of Artificial Sequence: Synthetic oligonucleotide
  Target: ANGPTL3; (-) strand; PAM type: YTN; PAM sequence: CTA
ctaagtaactatgtgatctt

SEQ ID NO: 11816 - DNA, 20 bp, Artificial Sequence
  Description of Artificial Sequence: Synthetic oligonucleotide
  Target: ANGPTL3; (-) strand; PAM type: YTN; PAM sequence: TTC
tactaagtaactatgtgatc

SEQ ID NO: 11817 - DNA, 20 bp, Artificial Sequence
  Description of Artificial Sequence: Synthetic oligonucleotide
  Target: ANGPTL3; (-) strand; PAM type: YTN; PAM sequence: TTT
ctactaagtaactatgtgat

SEQ ID NO: 11818 - DNA, 20 bp, Artificial Sequence
  Description of Artificial Sequence: Synthetic oligonucleotide
  Target: ANGPTL3; (-) strand; PAM type: YTN; PAM sequence: TTT
tctactaagtaactatgtga

SEQ ID NO: 11819 - DNA, 20 bp, Artificial Sequence
  Description of Artificial Sequence: Synthetic oligonucleotide
  Target: ANGPTL3; (-) strand; PAM type: YTN; PAM sequence: CTT
ttctactaagtaactatgtg

SEQ ID NO: 11820 - DNA, 20 bp, Artificial Sequence
  Description of Artificial Sequence: Synthetic oligonucleotide
  Target: ANGPTL3; (-) strand; PAM type: YTN; PAM sequence: CTC
ttttctactaagtaactatg

SEQ ID NO: 11821 - DNA, 20 bp, Artificial Sequence
  Description of Artificial Sequence: Synthetic oligonucleotide
  Target: ANGPTL3; (-) strand; PAM type: YTN; PAM sequence: TTA
ctcttttctactaagtaact

SEQ ID NO: 11822 - DNA, 20 bp, Artificial Sequence
  Description of Artificial Sequence: Synthetic oligonucleotide
  Target: ANGPTL3; (-) strand; PAM type: YTN; PAM sequence: CTG
ggtattactcttttctacta

SEQ ID NO: 11823 - DNA, 20 bp, Artificial Sequence
  Description of Artificial Sequence: Synthetic oligonucleotide
  Target: ANGPTL3; (-) strand; PAM type: YTN; PAM sequence: TTG
ctgggtattactcttttcta

SEQ ID NO: 11824 - DNA, 20 bp, Artificial Sequence
  Description of Artificial Sequence: Synthetic oligonucleotide
  Target: ANGPTL3; (-) strand; PAM type: YTN; PAM sequence: CTT
gctgggtattactcttttct

SEQ ID NO: 11825 - DNA, 20 bp, Artificial Sequence
  Description of Artificial Sequence: Synthetic oligonucleotide
  Target: ANGPTL3; (-) strand; PAM type: YTN; PAM sequence: TTG
cttgctgggtattactcttt

SEQ ID NO: 11826 - DNA, 20 bp, Artificial Sequence
  Description of Artificial Sequence: Synthetic oligonucleotide
  Target: ANGPTL3; (-) strand; PAM type: YTN; PAM sequence: TTT
gcttgctgggtattactctt

SEQ ID NO: 11827 - DNA, 20 bp, Artificial Sequence
  Description of Artificial Sequence: Synthetic oligonucleotide
  Target: ANGPTL3; (-) strand; PAM type: YTN; PAM sequence: TTG
taaagtttgcttgctgggta

SEQ ID NO: 11828 - DNA, 20 bp, Artificial Sequence
  Description of Artificial Sequence: Synthetic oligonucleotide
  Target: ANGPTL3; (-) strand; PAM type: YTN; PAM sequence: CTA
ttgtaaagtttgcttgctgg

SEQ ID NO: 11829 - DNA, 20 bp, Artificial Sequence
  Description of Artificial Sequence: Synthetic oligonucleotide
  Target: ANGPTL3; (-) strand; PAM type: YTN; PAM sequence: TTA
aaaggatctattgtaaagtt

SEQ ID NO: 11830 - DNA, 20 bp, Artificial Sequence
  Description of Artificial Sequence: Synthetic oligonucleotide
  Target: ANGPTL3; (-) strand; PAM type: YTN; PAM sequence: TTT
aaaaggatctattgtaaagt

SEQ ID NO: 11831 - DNA, 20 bp, Artificial Sequence
  Description of Artificial Sequence: Synthetic oligonucleotide
  Target: ANGPTL3; (-) strand; PAM type: YTN; PAM sequence: TTA
tttaaaaggatctattgtaa

SEQ ID NO: 11832 - DNA, 20 bp, Artificial Sequence
  Description of Artificial Sequence: Synthetic oligonucleotide
  Target: ANGPTL3; (-) strand; PAM type: YTN; PAM sequence: CTT
atttaaaaggatctattgta

SEQ ID NO: 11833 - DNA, 20 bp, Artificial Sequence
  Description of Artificial Sequence: Synthetic oligonucleotide
  Target: ANGPTL3; (-) strand; PAM type: YTN; PAM sequence: CTA
ggaccttatttaaaaggatc

SEQ ID NO: 11834 - DNA, 20 bp, Artificial Sequence
  Description of Artificial Sequence: Synthetic oligonucleotide
  Target: ANGPTL3; (-) strand; PAM type: YTN; PAM sequence: TTC
ctaggaccttatttaaaagg

SEQ ID NO: 11835 - DNA, 20 bp, Artificial Sequence
  Description of Artificial Sequence: Synthetic oligonucleotide
  Target: ANGPTL3; (-) strand; PAM type: YTN; PAM sequence: TTT
cctaggaccttatttaaaag

SEQ ID NO: 11836 - DNA, 20 bp, Artificial Sequence
  Description of Artificial Sequence: Synthetic oligonucleotide
  Target: ANGPTL3; (-) strand; PAM type: YTN; PAM sequence: CTG
gcatgaatgatatttcctag

SEQ ID NO: 11837 - DNA, 20 bp, Artificial Sequence
  Description of Artificial Sequence: Synthetic oligonucleotide
  Target: ANGPTL3; (-) strand; PAM type: YTN; PAM sequence: TTG
atgctggcatgaatgatatt

SEQ ID NO: 11838 - DNA, 20 bp, Artificial Sequence
  Description of Artificial Sequence: Synthetic oligonucleotide
  Target: ANGPTL3; (-) strand; PAM type: YTN; PAM sequence: TTT
gatgctggcatgaatgatat

SEQ ID NO: 11839 - DNA, 20 bp, Artificial Sequence
  Description of Artificial Sequence: Synthetic oligonucleotide
  Target: ANGPTL3; (-) strand; PAM type: YTN; PAM sequence: TTT
tgatgctggcatgaatgata

SEQ ID NO: 11840 - DNA, 20 bp, Artificial Sequence
  Description of Artificial Sequence: Synthetic oligonucleotide
  Target: ANGPTL3; (-) strand; PAM type: YTN; PAM sequence: TTT
ttgatgctggcatgaatgat

SEQ ID NO: 11841 - DNA, 20 bp, Artificial Sequence
  Description of Artificial Sequence: Synthetic oligonucleotide
  Target: ANGPTL3; (-) strand; PAM type: YTN; PAM sequence: TTT
tttgatgctggcatgaatga

SEQ ID NO: 11842 - DNA, 20 bp, Artificial Sequence
  Description of Artificial Sequence: Synthetic oligonucleotide
  Target: ANGPTL3; (-) strand; PAM type: YTN; PAM sequence: TTA
gttttttgatgctggcatga

SEQ ID NO: 11843 - DNA, 20 bp, Artificial Sequence
  Description of Artificial Sequence: Synthetic oligonucleotide
  Target: ANGPTL3; (-) strand; PAM type: YTN; PAM sequence: TTA
gtgttagttttttgatgctg

SEQ ID NO: 11844 - DNA, 20 bp, Artificial Sequence
  Description of Artificial Sequence: Synthetic oligonucleotide
  Target: ANGPTL3; (-) strand; PAM type: YTN; PAM sequence: TTA
ttagtgttagttttttgatg

SEQ ID NO: 11845 - DNA, 20 bp, Artificial Sequence
  Description of Artificial Sequence: Synthetic oligonucleotide
  Target: ANGPTL3; (-) strand; PAM type: YTN; PAM sequence: TTG
cattattagtgttagttttt

SEQ ID NO: 11846 - DNA, 20 bp, Artificial Sequence
  Description of Artificial Sequence: Synthetic oligonucleotide
  Target: ANGPTL3; (-) strand; PAM type: YTN; PAM sequence: CTT
gcattattagtgttagtttt

SEQ ID NO: 11847 - DNA, 20 bp, Artificial Sequence
  Description of Artificial Sequence: Synthetic oligonucleotide
  Target: ANGPTL3; (-) strand; PAM type: YTN; PAM sequence: TTG
acagtaagaaaagcagaata

SEQ ID NO: 11848 - DNA, 20 bp, Artificial Sequence
  Description of Artificial Sequence: Synthetic oligonucleotide
  Target: ANGPTL3; (-) strand; PAM type: YTN; PAM sequence: CTC
attgacagtaagaaaagcag

SEQ ID NO: 11849 - DNA, 20 bp, Artificial Sequence
  Description of Artificial Sequence: Synthetic oligonucleotide
  Target: ANGPTL3; (-) strand; PAM type: YTN; PAM sequence: TTC
tcattgacagtaagaaaagc

SEQ ID NO: 11850 - DNA, 20 bp, Artificial Sequence
  Description of Artificial Sequence: Synthetic oligonucleotide
  Target: ANGPTL3; (-) strand; PAM type: YTN; PAM sequence: TTT
ctcattgacagtaagaaaag

SEQ ID NO: 11851 - DNA, 20 bp, Artificial Sequence
  Description of Artificial Sequence: Synthetic oligonucleotide
  Target: ANGPTL3; (-) strand; PAM type: YTN; PAM sequence: TTT
tctcattgacagtaagaaaa

SEQ ID NO: 11852 - DNA, 20 bp, Artificial Sequence
  Description of Artificial Sequence: Synthetic oligonucleotide
  Target: ANGPTL3; (-) strand; PAM type: YTN; PAM sequence: TTT
ttctcattgacagtaagaaa

SEQ ID NO: 11853 - DNA, 20 bp, Artificial Sequence
  Description of Artificial Sequence: Synthetic oligonucleotide
  Target: ANGPTL3; (-) strand; PAM type: YTN; PAM sequence: TTG
aatgatagtttttctcattg

SEQ ID NO: 11854 - DNA, 20 bp, Artificial Sequence
  Description of Artificial Sequence: Synthetic oligonucleotide
  Target: ANGPTL3; (-) strand; PAM type: YTN; PAM sequence: TTA
ttgaatgatagtttttctca

SEQ ID NO: 11855 - DNA, 20 bp, Artificial Sequence
  Description of Artificial Sequence: Synthetic oligonucleotide
  Target: ANGPTL3; (-) strand; PAM type: YTN; PAM sequence: TTT
attgaatgatagtttttctc

SEQ ID NO: 11856 - DNA, 20 bp, Artificial Sequence
  Description of Artificial Sequence: Synthetic oligonucleotide
  Target: ANGPTL3; (-) strand; PAM type: YTN; PAM sequence: TTG
caatttattgaatgatagtt

SEQ ID NO: 11857 - DNA, 20 bp, Artificial Sequence
  Description of Artificial Sequence: Synthetic oligonucleotide
  Target: ANGPTL3; (-) strand; PAM type: YTN; PAM sequence: TTT
gcaatttattgaatgatagt

SEQ ID NO: 11858 - DNA, 20 bp, Artificial Sequence
  Description of Artificial Sequence: Synthetic oligonucleotide
  Target: ANGPTL3; (-) strand; PAM type: YTN; PAM sequence: TTG
ggtttgcaatttattgaatg

SEQ ID NO: 11859 - DNA, 20 bp, Artificial Sequence
  Description of Artificial Sequence: Synthetic oligonucleotide
  Target: ANGPTL3; (-) strand; PAM type: YTN; PAM sequence: TTA
agtgtgttgggtttgcaatt

SEQ ID NO: 11860 - DNA, 20 bp, Artificial Sequence
  Description of Artificial Sequence: Synthetic oligonucleotide
  Target: ANGPTL3; (-) strand; PAM type: YTN; PAM sequence: TTT
aagtgtgttgggtttgcaat

SEQ ID NO: 11861 - DNA, 20 bp, Artificial Sequence
  Description of Artificial Sequence: Synthetic oligonucleotide
  Target: ANGPTL3; (-) strand; PAM type: YTN; PAM sequence: TTA
tttaagtgtgttgggtttgc

SEQ ID NO: 11862 - DNA, 20 bp, Artificial Sequence
  Description of Artificial Sequence: Synthetic oligonucleotide
  Target: ANGPTL3; (-) strand; PAM type: YTN; PAM sequence: TTT
atttaagtgtgttgggtttg

SEQ ID NO: 11863 - DNA, 20 bp, Artificial Sequence
  Description of Artificial Sequence: Synthetic oligonucleotide
  Target: ANGPTL3; (-) strand; PAM type: YTN; PAM sequence: TTT
tatttaagtgtgttgggttt

SEQ ID NO: 11864 - DNA, 20 bp, Artificial Sequence
  Description of Artificial Sequence: Synthetic oligonucleotide
  Target: ANGPTL3; (-) strand; PAM type: YTN; PAM sequence: TTT
ttatttaagtgtgttgggtt

SEQ ID NO: 11865 - DNA, 20 bp, Artificial Sequence
  Description of Artificial Sequence: Synthetic oligonucleotide
  Target: ANGPTL3; (-) strand; PAM type: YTN; PAM sequence: TTA
tttttatttaagtgtgttgg

SEQ ID NO: 11866 - DNA, 20 bp, Artificial Sequence
  Description of Artificial Sequence: Synthetic oligonucleotide
  Target: ANGPTL3; (-) strand; PAM type: YTN; PAM sequence: TTT
atttttatttaagtgtgttg

SEQ ID NO: 11867 - DNA, 20 bp, Artificial Sequence
  Description of Artificial Sequence: Synthetic oligonucleotide
  Target: ANGPTL3; (-) strand; PAM type: YTN; PAM sequence: TTT
tatttttatttaagtgtgtt

SEQ ID NO: 11868 - DNA, 20 bp, Artificial Sequence
  Description of Artificial Sequence: Synthetic oligonucleotide
  Target: ANGPTL3; (-) strand; PAM type: YTN; PAM sequence: TTA
gcagtaacattttattttta

SEQ ID NO: 11869 - DNA, 20 bp, Artificial Sequence
  Description of Artificial Sequence: Synthetic oligonucleotide
  Target: ANGPTL3; (-) strand; PAM type: YTN; PAM sequence: TTT
agcagtaacattttattttt

SEQ ID NO: 11870 - DNA, 20 bp, Artificial Sequence
  Description of Artificial Sequence: Synthetic oligonucleotide
  Target: ANGPTL3; (-) strand; PAM type: YTN; PAM sequence: TTA
gtttagcagtaacattttat

SEQ ID NO: 11871 - DNA, 20 bp, Artificial Sequence
  Description of Artificial Sequence: Synthetic oligonucleotide
  Target: ANGPTL3; (-) strand; PAM type: YTN; PAM sequence: TTA
tcgttagtttagcagtaaca

SEQ ID NO: 11872 - DNA, 20 bp, Artificial Sequence
  Description of Artificial Sequence: Synthetic oligonucleotide
  Target: ANGPTL3; (-) strand; PAM type: YTN; PAM sequence: TTT
atcgttagtttagcagtaac

SEQ ID NO: 11873 - DNA, 20 bp, Artificial Sequence
  Description of Artificial Sequence: Synthetic oligonucleotide
  Target: ANGPTL3; (-) strand; PAM type: YTN; PAM sequence: TTC
agtagtttatcgttagttta

SEQ ID NO: 11874 - DNA, 20 bp, Artificial Sequence
  Description of Artificial Sequence: Synthetic oligonucleotide
  Target: ANGPTL3; (-) strand; PAM type: YTN; PAM sequence: CTA
tatattcagtagtttatcgt

SEQ ID NO: 11875 - DNA, 20 bp, Artificial Sequence
  Description of Artificial Sequence: Synthetic oligonucleotide
  Target: ANGPTL3; (-) strand; PAM type: YTN; PAM sequence: TTC
tatatattcagtagtttatc

SEQ ID NO: 11876 - DNA, 20 bp, Artificial Sequence
  Description of Artificial Sequence: Synthetic oligonucleotide
  Target: ANGPTL3; (-) strand; PAM type: YTN; PAM sequence: TTT
ctatatattcagtagtttat

SEQ ID NO: 11877 - DNA, 20 bp, Artificial Sequence
  Description of Artificial Sequence: Synthetic oligonucleotide
  Target: ANGPTL3; (-) strand; PAM type: YTN; PAM sequence: CTT
tctatatattcagtagttta

SEQ ID NO: 11878 - DNA, 20 bp, Artificial Sequence
  Description of Artificial Sequence: Synthetic oligonucleotide
  Target: ANGPTL3; (-) strand; PAM type: YTN; PAM sequence: TTA
ctttctatatattcagtagt

SEQ ID NO: 11879 - DNA, 20 bp, Artificial Sequence
  Description of Artificial Sequence: Synthetic oligonucleotide
  Target: ANGPTL3; (-) strand; PAM type: YTN; PAM sequence: CTT
actttctatatattcagtag

SEQ ID NO: 11880 - DNA, 20 bp, Artificial Sequence
  Description of Artificial Sequence: Synthetic oligonucleotide
  Target: ANGPTL3; (-) strand; PAM type: YTN; PAM sequence: TTG
cttactttctatatattcag

SEQ ID NO: 11881 - DNA, 20 bp, Artificial Sequence
  Description of Artificial Sequence: Synthetic oligonucleotide
  Target: ANGPTL3; (-) strand; PAM type: YTN; PAM sequence: TTT
gcttactttctatatattca

SEQ ID NO: 11882 - DNA, 20 bp, Artificial Sequence
  Description of Artificial Sequence: Synthetic oligonucleotide
  Target: ANGPTL3; (-) strand; PAM type: YTN; PAM sequence: TTG
tttgcttactttctatatat

SEQ ID NO: 11883 - DNA, 20 bp, Artificial Sequence
  Description of Artificial Sequence: Synthetic oligonucleotide
  Target: ANGPTL3; (-) strand; PAM type: YTN; PAM sequence: TTT
gtttgcttactttctatata

SEQ ID NO: 11884 - DNA, 20 bp, Artificial Sequence
  Description of Artificial Sequence: Synthetic oligonucleotide
  Target: ANGPTL3; (-) strand; PAM type: YTN; PAM sequence: TTG
gcaagtttgtttgcttactt

SEQ ID NO: 11885 - DNA, 20 bp, Artificial Sequence
  Description of Artificial Sequence: Synthetic oligonucleotide
  Target: ANGPTL3; (-) strand; PAM type: YTN; PAM sequence: TTG
gcaggttggcaagtttgttt

SEQ ID NO: 11886 - DNA, 20 bp, Artificial Sequence
  Description of Artificial Sequence: Synthetic oligonucleotide
  Target: ANGPTL3; (-) strand; PAM type: YTN; PAM sequence: CTG
tagatgttggcaggttggca

SEQ ID NO: 11887 - DNA, 20 bp, Artificial Sequence
  Description of Artificial Sequence: Synthetic oligonucleotide
  Target: ANGPTL3; (-) strand; PAM type: YTN; PAM sequence: CTG
taaacatatctgtagatgtt

SEQ ID NO: 11888 - DNA, 20 bp, Artificial Sequence
  Description of Artificial Sequence: Synthetic oligonucleotide
  Target: ANGPTL3; (-) strand; PAM type: YTN; PAM sequence: TTG
acctgtaaacatatctgtag

SEQ ID NO: 11889 - DNA, 20 bp, Artificial Sequence
  Description of Artificial Sequence: Synthetic oligonucleotide
  Target: ANGPTL3; (-) strand; PAM type: YTN; PAM sequence: TTT
gacctgtaaacatatctgta

SEQ ID NO: 11890 - DNA, 20 bp, Artificial Sequence
  Description of Artificial Sequence: Synthetic oligonucleotide
  Target: ANGPTL3; (-) strand; PAM type: YTN; PAM sequence: TTT
tgacctgtaaacatatctgt

SEQ ID NO: 11891 - DNA, 20 bp, Artificial Sequence
  Description of Artificial Sequence: Synthetic oligonucleotide
  Target: ANGPTL3; (-) strand; PAM type: YTN; PAM sequence: TTT
ttgacctgtaaacatatctg

SEQ ID NO: 11892 - DNA, 20 bp, Artificial Sequence
  Description of Artificial Sequence: Synthetic oligonucleotide
  Target: ANGPTL3; (-) strand; PAM type: YTN; PAM sequence: TTG
ataatttttgacctgtaaac

SEQ ID NO: 11893 - DNA, 20 bp, Artificial Sequence
  Description of Artificial Sequence: Synthetic oligonucleotide
  Target: ANGPTL3; (-) strand; PAM type: YTN; PAM sequence: TTT
gataatttttgacctgtaaa

SEQ ID NO: 11894 - DNA, 20 bp, Artificial Sequence
  Description of Artificial Sequence: Synthetic oligonucleotide
  Target: ANGPTL3; (-) strand; PAM type: YTN; PAM sequence: TTG
ataatttgataatttttgac

SEQ ID NO: 11895 - DNA, 20 bp, Artificial Sequence
  Description of Artificial Sequence: Synthetic oligonucleotide
  Target: ANGPTL3; (-) strand; PAM type: YTN; PAM sequence: CTT
gataatttgataatttttga

SEQ ID NO: 11896 - DNA, 20 bp, Artificial Sequence
  Description of Artificial Sequence: Synthetic oligonucleotide
  Target: ANGPTL3; (-) strand; PAM type: YTN; PAM sequence: TTC
ttgataatttgataattttt

SEQ ID NO: 11897 - DNA, 20 bp, Artificial Sequence
  Description of Artificial Sequence: Synthetic oligonucleotide
  Target: ANGPTL3; (-) strand; PAM type: YTN; PAM sequence: TTT
cttgataatttgataatttt

SEQ ID NO: 11898 - DNA, 20 bp, Artificial Sequence
  Description of Artificial Sequence: Synthetic oligonucleotide
  Target: ANGPTL3; (-) strand; PAM type: YTN; PAM sequence: CTT
tcttgataatttgataattt

SEQ ID NO: 11899 - DNA, 20 bp, Artificial Sequence
  Description of Artificial Sequence: Synthetic oligonucleotide
  Target: ANGPTL3; (-) strand; PAM type: YTN; PAM sequence: TTG
aaccaggctttcttgataat

SEQ ID NO: 11900 - DNA, 20 bp, Artificial Sequence
  Description of Artificial Sequence: Synthetic oligonucleotide
  Target: ANGPTL3; (-) strand; PAM type: YTN; PAM sequence: TTT
gaaccaggctttcttgataa

SEQ ID NO: 11901 - DNA, 20 bp, Artificial Sequence
  Description of Artificial Sequence: Synthetic oligonucleotide
  Target: ANGPTL3; (-) strand; PAM type: YTN; PAM sequence: CTG
tgataaagacataatacata

SEQ ID NO: 11902 - DNA, 20 bp, Artificial Sequence
  Description of Artificial Sequence: Synthetic oligonucleotide
  Target: ANGPTL3; (-) strand; PAM type: YTN; PAM sequence: TTC
agacctgtgataaagacata

SEQ ID NO: 11903 - DNA, 20 bp, Artificial Sequence
  Description of Artificial Sequence: Synthetic oligonucleotide
  Target: ANGPTL3; (-) strand; PAM type: YTN; PAM sequence: CTT
cagacctgtgataaagacat

SEQ ID NO: 11904 - DNA, 20 bp, Artificial Sequence
  Description of Artificial Sequence: Synthetic oligonucleotide
  Target: ANGPTL3; (-) strand; PAM type: YTN; PAM sequence: CTG
atcttcagacctgtgataaa

SEQ ID NO: 11905 - DNA, 20 bp, Artificial Sequence
  Description of Artificial Sequence: Synthetic oligonucleotide
  Target: ANGPTL3; (-) strand; PAM type: YTN; PAM sequence: TTA
ctgatcttcagacctgtgat

SEQ ID NO: 11906 - DNA, 20 bp, Artificial Sequence
  Description of Artificial Sequence: Synthetic oligonucleotide
  Target: ANGPTL3; (-) strand; PAM type: YTN; PAM sequence: CTT
actgatcttcagacctgtga

SEQ ID NO: 11907 - DNA, 20 bp, Artificial Sequence
  Description of Artificial Sequence: Synthetic oligonucleotide
  Target: ANGPTL3; (-) strand; PAM type: YTN; PAM sequence: TTA
ggtcttactgatcttcagac

SEQ ID NO: 11908 - DNA, 20 bp, Artificial Sequence
  Description of Artificial Sequence: Synthetic oligonucleotide
  Target: ANGPTL3; (-) strand; PAM type: YTN; PAM sequence: TTT
aggtcttactgatcttcaga

SEQ ID NO: 11909 - DNA, 20 bp, Artificial Sequence
  Description of Artificial Sequence: Synthetic oligonucleotide
  Target: ANGPTL3; (-) strand; PAM type: YTN; PAM sequence: TTT
taggtcttactgatcttcag

SEQ ID NO: 11910 - DNA, 20 bp, Artificial Sequence
  Description of Artificial Sequence: Synthetic oligonucleotide
  Target: ANGPTL3; (-) strand; PAM type: YTN; PAM sequence: TTC
agttttaggtcttactgatc

SEQ ID NO: 11911 - DNA, 20 bp, Artificial Sequence
  Description of Artificial Sequence: Synthetic oligonucleotide
  Target: ANGPTL3; (-) strand; PAM type: YTN; PAM sequence: TTT
cagttttaggtcttactgat

SEQ ID NO: 11912 - DNA, 20 bp, Artificial Sequence
  Description of Artificial Sequence: Synthetic oligonucleotide
  Target: ANGPTL3; (-) strand; PAM type: YTN; PAM sequence: TTT
tcagttttaggtcttactga

SEQ ID NO: 11913 - DNA, 20 bp, Artificial Sequence
  Description of Artificial Sequence: Synthetic oligonucleotide
  Target: ANGPTL3; (-) strand; PAM type: YTN; PAM sequence: TTA
ataattttcagttttaggtc

SEQ ID NO: 11914 - DNA, 20 bp, Artificial Sequence
  Description of Artificial Sequence: Synthetic oligonucleotide
  Target: ANGPTL3; (-) strand; PAM type: YTN; PAM sequence: TTT
aataattttcagttttaggt

SEQ ID NO: 11915 - DNA, 20 bp, Artificial Sequence
  Description of Artificial Sequence: Synthetic oligonucleotide
  Target: ANGPTL3; (-) strand; PAM type: YTN; PAM sequence: TTA
agtttaataattttcagttt

SEQ ID NO: 11916 - DNA, 20 bp, Artificial Sequence
  Description of Artificial Sequence: Synthetic oligonucleotide
  Target: ANGPTL3; (-) strand; PAM type: YTN; PAM sequence: TTT
aagtttaataattttcagtt

SEQ ID NO: 11917 - DNA, 20 bp, Artificial Sequence
  Description of Artificial Sequence: Synthetic oligonucleotide
  Target: ANGPTL3; (-) strand; PAM type: YTN; PAM sequence: TTT
taagtttaataattttcagt

SEQ ID NO: 11918 - DNA, 20 bp, Artificial Sequence
  Description of Artificial Sequence: Synthetic oligonucleotide
  Target: ANGPTL3; (-) strand; PAM type: YTN; PAM sequence: TTC
agattttaagtttaataatt

SEQ ID NO: 11919 - DNA, 20 bp, Artificial Sequence
  Description of Artificial Sequence: Synthetic oligonucleotide
  Target: ANGPTL3; (-) strand; PAM type: YTN; PAM sequence: CTG
ttcagattttaagtttaata

SEQ ID NO: 11920 - DNA, 20 bp, Artificial Sequence
  Description of Artificial Sequence: Synthetic oligonucleotide
  Target: ANGPTL3; (-) strand; PAM type: YTN; PAM sequence: TTC
tgttcagattttaagtttaa

SEQ ID NO: 11921 - DNA, 20 bp, Artificial Sequence
  Description of Artificial Sequence: Synthetic oligonucleotide
  Target: ANGPTL3; (-) strand; PAM type: YTN; PAM sequence: TTG
atattctgttcagattttaa

SEQ ID NO: 11922 - DNA, 20 bp, Artificial Sequence
  Description of Artificial Sequence: Synthetic oligonucleotide
  Target: ANGPTL3; (-) strand; PAM type: YTN; PAM sequence: TTT
gatattctgttcagatttta

SEQ ID NO: 11923 - DNA, 20 bp, Artificial Sequence
  Description of Artificial Sequence: Synthetic oligonucleotide
  Target: ANGPTL3; (-) strand; PAM type: YTN; PAM sequence: TTA
tatgaataaaatatatttga

SEQ ID NO: 11924 - DNA, 20 bp, Artificial Sequence
  Description of Artificial Sequence: Synthetic oligonucleotide
  Target: ANGPTL3; (-) strand; PAM type: YTN; PAM sequence: TTT
atatgaataaaatatatttg

SEQ ID NO: 11925 - DNA, 20 bp, Artificial Sequence
  Description of Artificial Sequence: Synthetic oligonucleotide
  Target: ANGPTL3; (-) strand; PAM type: YTN; PAM sequence: TTA
tttatatgaataaaatatat

SEQ ID NO: 11926 - DNA, 20 bp, Artificial Sequence
  Description of Artificial Sequence: Synthetic oligonucleotide
  Target: ANGPTL3; (-) strand; PAM type: YTN; PAM sequence: TTT
atttatatgaataaaatata

SEQ ID NO: 11927 - DNA, 20 bp, Artificial Sequence
  Description of Artificial Sequence: Synthetic oligonucleotide
  Target: ANGPTL3; (-) strand; PAM type: YTN; PAM sequence: TTT
tatttatatgaataaaatat

SEQ ID NO: 11928 - DNA, 20 bp, Artificial Sequence
  Description of Artificial Sequence: Synthetic oligonucleotide
  Target: ANGPTL3; (-) strand; PAM type: YTN; PAM sequence: CTT
ttatttatatgaataaaata

SEQ ID NO: 11929 - DNA, 20 bp, Artificial Sequence
  Description of Artificial Sequence: Synthetic oligonucleotide
  Target: ANGPTL3; (-) strand; PAM type: YTN; PAM sequence: TTC
ttttatttatatgaataaaa

SEQ ID NO: 11930 - DNA, 20 bp, Artificial Sequence
  Description of Artificial Sequence: Synthetic oligonucleotide
  Target: ANGPTL3; (-) strand; PAM type: YTN; PAM sequence: TTG
taatgtattcttttatttat

SEQ ID NO: 11931 - DNA, 20 bp, Artificial Sequence
  Description of Artificial Sequence: Synthetic oligonucleotide
  Target: ANGPTL3; (-) strand; PAM type: YTN; PAM sequence: TTA
gaatattgtaatgtattctt

SEQ ID NO: 11932 - DNA, 20 bp, Artificial Sequence
  Description of Artificial Sequence: Synthetic oligonucleotide
  Target: ANGPTL3; (-) strand; PAM type: YTN; PAM sequence: CTT
agaatattgtaatgtattct

SEQ ID NO: 11933 - DNA, 20 bp, Artificial Sequence
  Description of Artificial Sequence: Synthetic oligonucleotide
  Target: ANGPTL3; (-) strand; PAM type: YTN; PAM sequence: TTG
cttagaatattgtaatgtat

SEQ ID NO: 11934 - DNA, 20 bp, Artificial Sequence
  Description of Artificial Sequence: Synthetic oligonucleotide
  Target: ANGPTL3; (-) strand; PAM type: YTN; PAM sequence: TTT
gcttagaatattgtaatgta

SEQ ID NO: 11935 - DNA, 20 bp, Artificial Sequence
  Description of Artificial Sequence: Synthetic oligonucleotide
  Target: ANGPTL3; (-) strand; PAM type: YTN; PAM sequence: CTT
tgcttagaatattgtaatgt

SEQ ID NO: 11936 - DNA, 20 bp, Artificial Sequence
  Description of Artificial Sequence: Synthetic oligonucleotide
  Target: ANGPTL3; (-) strand; PAM type: YTN; PAM sequence: CTG
ctttgcttagaatattgtaa

SEQ ID NO: 11937 - DNA, 20 bp, Artificial Sequence
  Description of Artificial Sequence: Synthetic oligonucleotide
  Target: ANGPTL3; (-) strand; PAM type: YTN; PAM sequence: TTG
gtcggaaaacagagcaaggc

SEQ ID NO: 11938 - DNA, 20 bp, Artificial Sequence
  Description of Artificial Sequence: Synthetic oligonucleotide
  Target: ANGPTL3; (-) strand; PAM type: YTN; PAM sequence: TTA
ataagataaaaaaataaagc

SEQ ID NO: 11939 - DNA, 20 bp, Artificial Sequence
  Description of Artificial Sequence: Synthetic oligonucleotide
  Target: ANGPTL3; (-) strand; PAM type: YTN; PAM sequence: TTT
aataagataaaaaaataaag

SEQ ID NO: 11940 - DNA, 20 bp, Artificial Sequence
  Description of Artificial Sequence: Synthetic oligonucleotide
  Target: ANGPTL3; (-) strand; PAM type: YTN; PAM sequence: TTA
tttaataagataaaaaaata

SEQ ID NO: 11941 - DNA, 20 bp, Artificial Sequence
  Description of Artificial Sequence: Synthetic oligonucleotide
  Target: ANGPTL3; (-) strand; PAM type: YTN; PAM sequence: TTA
atcagggacattatttaata

SEQ ID NO: 11942 - DNA, 20 bp, Artificial Sequence
  Description of Artificial Sequence: Synthetic oligonucleotide
  Target: ANGPTL3; (-) strand; PAM type: YTN; PAM sequence: TTT
aatcagggacattatttaat

SEQ ID NO: 11943 - DNA, 20 bp, Artificial Sequence
  Description of Artificial Sequence: Synthetic oligonucleotide
  Target: ANGPTL3; (-) strand; PAM type: YTN; PAM sequence: CTC
aaaatatttaatcagggaca

SEQ ID NO: 11944 - DNA, 20 bp, Artificial Sequence
  Description of Artificial Sequence: Synthetic oligonucleotide
  Target: ANGPTL3; (-) strand; PAM type: YTN; PAM sequence: TTC
tcaaaatatttaatcaggga

SEQ ID NO: 11945 - DNA, 20 bp, Artificial Sequence
  Description of Artificial Sequence: Synthetic oligonucleotide
  Target: ANGPTL3; (-) strand; PAM type: YTN; PAM sequence: CTG
ttctcaaaatatttaatcag

SEQ ID NO: 11946 - DNA, 20 bp, Artificial Sequence
  Description of Artificial Sequence: Synthetic oligonucleotide
  Target: ANGPTL3; (-) strand; PAM type: YTN; PAM sequence: TTA
cctgttctcaaaatatttaa

SEQ ID NO: 11947 - DNA, 20 bp, Artificial Sequence
  Description of Artificial Sequence: Synthetic oligonucleotide
  Target: ANGPTL3; (-) strand; PAM type: YTN; PAM sequence: TTG
tacagattacctgttctcaa

SEQ ID NO: 11948 - DNA, 20 bp, Artificial Sequence
  Description of Artificial Sequence: Synthetic oligonucleotide
  Target: ANGPTL3; (-) strand; PAM type: YTN; PAM sequence: TTC
agattgtacagattacctgt

SEQ ID NO: 11949 - DNA, 20 bp, Artificial Sequence
  Description of Artificial Sequence: Synthetic oligonucleotide
  Target: ANGPTL3; (-) strand; PAM type: YTN; PAM sequence: TTA
ttcagattgtacagattacc

SEQ ID NO: 11950 - DNA, 20 bp, Artificial Sequence
  Description of Artificial Sequence: Synthetic oligonucleotide
  Target: ANGPTL3; (-) strand; PAM type: YTN; PAM sequence: TTA
gataaacagtgttattcaga

SEQ ID NO: 11951 - DNA, 20 bp, Artificial Sequence
  Description of Artificial Sequence: Synthetic oligonucleotide
  Target: ANGPTL3; (-) strand; PAM type: YTN; PAM sequence: TTT
agataaacagtgttattcag

SEQ ID NO: 11952 - DNA, 20 bp, Artificial Sequence
  Description of Artificial Sequence: Synthetic oligonucleotide
  Target: ANGPTL3; (-) strand; PAM type: YTN; PAM sequence: TTG
atatttagataaacagtgtt

SEQ ID NO: 11953 - DNA, 20 bp, Artificial Sequence
  Description of Artificial Sequence: Synthetic oligonucleotide
  Target: ANGPTL3; (-) strand; PAM type: YTN; PAM sequence: TTT
gatatttagataaacagtgt

SEQ ID NO: 11954 - DNA, 20 bp, Artificial Sequence
  Description of Artificial Sequence: Synthetic oligonucleotide
  Target: ANGPTL3; (-) strand; PAM type: YTN; PAM sequence: TTA
taacggtgtttgatatttag

SEQ ID NO: 11955 - DNA, 20 bp, Artificial Sequence
  Description of Artificial Sequence: Synthetic oligonucleotide
  Target: ANGPTL3; (-) strand; PAM type: YTN; PAM sequence: TTC
ataatgttataacggtgttt

SEQ ID NO: 11956 - DNA, 20 bp, Artificial Sequence
  Description of Artificial Sequence: Synthetic oligonucleotide
  Target: ANGPTL3; (-) strand; PAM type: YTN; PAM sequence: TTC
agttcataatgttataacgg

SEQ ID NO: 11957 - DNA, 20 bp, Artificial Sequence
  Description of Artificial Sequence: Synthetic oligonucleotide
  Target: ANGPTL3; (-) strand; PAM type: YTN; PAM sequence: TTT
cagttcataatgttataacg

SEQ ID NO: 11958 - DNA, 20 bp, Artificial Sequence
  Description of Artificial Sequence: Synthetic oligonucleotide
  Target: ANGPTL3; (-) strand; PAM type: YTN; PAM sequence: CTT
tcagttcataatgttataac

SEQ ID NO: 11959 - DNA, 20 bp, Artificial Sequence
  Description of Artificial Sequence: Synthetic oligonucleotide
  Target: ANGPTL3; (-) strand; PAM type: YTN; PAM sequence: TTG
tctttcagttcataatgtta

SEQ ID NO: 11960 - DNA, 20 bp, Artificial Sequence
  Description of Artificial Sequence: Synthetic oligonucleotide
  Target: ANGPTL3; (-) strand; PAM type: YTN; PAM sequence: TTT
gtctttcagttcataatgtt

SEQ ID NO: 11961 - DNA, 20 bp, Artificial Sequence
  Description of Artificial Sequence: Synthetic oligonucleotide
  Target: ANGPTL3; (-) strand; PAM type: YTN; PAM sequence: CTG
agtaaggatgtcagaagtac

SEQ ID NO: 11962 - DNA, 20 bp, Artificial Sequence
  Description of Artificial Sequence: Synthetic oligonucleotide
  Target: ANGPTL3; (-) strand; PAM type: YTN; PAM sequence: TTA
ggggaaatctgagtaaggat

SEQ ID NO: 11963 - DNA, 20 bp, Artificial Sequence
  Description of Artificial Sequence: Synthetic oligonucleotide
  Target: ANGPTL3; (-) strand; PAM type: YTN; PAM sequence: CTG
aatatacaattaggggaaat

SEQ ID NO: 11964 - DNA, 20 bp, Artificial Sequence
  Description of Artificial Sequence: Synthetic oligonucleotide
  Target: ANGPTL3; (-) strand; PAM type: YTN; PAM sequence: TTA
aaatgatactgaatatacaa

SEQ ID NO: 11965 - DNA, 20 bp, Artificial Sequence
  Description of Artificial Sequence: Synthetic oligonucleotide
  Target: ANGPTL3; (-) strand; PAM type: YTN; PAM sequence: TTT
aaaatgatactgaatataca

SEQ ID NO: 11966 - DNA, 20 bp, Artificial Sequence
  Description of Artificial Sequence: Synthetic oligonucleotide
  Target: ANGPTL3; (-) strand; PAM type: YTN; PAM sequence: TTT
taaaatgatactgaatatac

SEQ ID NO: 11967 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaatgatactgaatata

SEQ ID NO: 11968 - DNA, 20 bp, Artificial Sequence
  Description of Artificial Sequence: Synthetic oligonucleotide
  Target: ANGPTL3; (-) strand; PAM type: YTN; PAM sequence: TTT
tttaaaatgatactgaatat

SEQ ID NO: 11969 - DNA, 20 bp, Artificial Sequence
  Description of Artificial Sequence: Synthetic oligonucleotide
  Target: ANGPTL3; (-) strand; PAM type: YTN; PAM sequence: CTG
ttttttaaaatgatactgaa

SEQ ID NO: 11970 - DNA, 20 bp, Artificial Sequence
  Description of Artificial Sequence: Synthetic oligonucleotide
  Target: ANGPTL3; (-) strand; PAM type: YTN; PAM sequence: CTG
ataaaagaatataaatctgt

SEQ ID NO: 11971 - DNA, 20 bp, Artificial Sequence
  Description of Artificial Sequence: Synthetic oligonucleotide
  Target: ANGPTL3; (-) strand; PAM type: YTN; PAM sequence: CTG
agctgataaaagaatataaa

SEQ ID NO: 11972 - DNA, 20 bp, Artificial Sequence
  Description of Artificial Sequence: Synthetic oligonucleotide
  Target: ANGPTL3; (-) strand; PAM type: YTN; PAM sequence: TTC
tgagctgataaaagaatata

SEQ ID NO: 11973 - DNA, 20 bp, Artificial Sequence
  Description of Artificial Sequence: Synthetic oligonucleotide
  Target: ANGPTL3; (-) strand; PAM type: YTN; PAM sequence: CTT
ctgagctgataaaagaatat

SEQ ID NO: 11974 - DNA, 20 bp, Artificial Sequence
  Description of Artificial Sequence: Synthetic oligonucleotide
  Target: ANGPTL3; (-) strand; PAM type: YTN; PAM sequence: CTA
gtccttctgagctgataaaa

SEQ ID NO: 11975 - DNA, 20 bp, Artificial Sequence
  Description of Artificial Sequence: Synthetic oligonucleotide
  Target: ANGPTL3; (-) strand; PAM type: YTN; PAM sequence: TTG
aatactagtccttctgagct

SEQ ID NO: 11976 - DNA, 20 bp, Artificial Sequence
  Description of Artificial Sequence: Synthetic oligonucleotide
  Target: ANGPTL3; (-) strand; PAM type: YTN; PAM sequence: CTT
gaatactagtccttctgagc

SEQ ID NO: 11977 - DNA, 20 bp, Artificial Sequence
  Description of Artificial Sequence: Synthetic oligonucleotide
  Target: ANGPTL3; (-) strand; PAM type: YTN; PAM sequence: TTC
ttgaatactagtccttctga

SEQ ID NO: 11978 - DNA, 20 bp, Artificial Sequence
  Description of Artificial Sequence: Synthetic oligonucleotide
  Target: ANGPTL3; (-) strand; PAM type: YTN; PAM sequence: CTG
tgggttcttgaatactagtc

SEQ ID NO: 11979 - DNA, 20 bp, Artificial Sequence
  Description of Artificial Sequence: Synthetic oligonucleotide
  Target: ANGPTL3; (-) strand; PAM type: YTN; PAM sequence: TTC
tgtgggttcttgaatactag

SEQ ID NO: 11980 - DNA, 20 bp, Artificial Sequence
  Description of Artificial Sequence: Synthetic oligonucleotide
  Target: ANGPTL3; (-) strand; PAM type: YTN; PAM sequence: TTT
ctgtgggttcttgaatacta

SEQ ID NO: 11981 - DNA, 20 bp, Artificial Sequence
  Description of Artificial Sequence: Synthetic oligonucleotide
  Target: ANGPTL3; (-) strand; PAM type: YTN; PAM sequence: TTG
gaagatagagaaatttctgt

SEQ ID NO: 11982 - DNA, 20 bp, Artificial Sequence
  Description of Artificial Sequence: Synthetic oligonucleotide
  Target: ANGPTL3; (-) strand; PAM type: YTN; PAM sequence: CTT
ggaagatagagaaatttctg

SEQ ID NO: 11983 - DNA, 20 bp, Artificial Sequence
  Description of Artificial Sequence: Synthetic oligonucleotide
  Target: ANGPTL3; (-) strand; PAM type: YTN; PAM sequence: TTG
gcttggaagatagagaaatt

SEQ ID NO: 11984 - DNA, 20 bp, Artificial Sequence
  Description of Artificial Sequence: Synthetic oligonucleotide
  Target: ANGPTL3; (-) strand; PAM type: YTN; PAM sequence: CTT
ggcttggaagatagagaaat

SEQ ID NO: 11985 - DNA, 20 bp, Artificial Sequence
  Description of Artificial Sequence: Synthetic oligonucleotide
  Target: ANGPTL3; (-) strand; PAM type: YTN; PAM sequence: CTC
ttggcttggaagatagagaa

SEQ ID NO: 11986 - DNA, 20 bp, Artificial Sequence
  Description of Artificial Sequence: Synthetic oligonucleotide
  Target: ANGPTL3; (-) strand; PAM type: YTN; PAM sequence: TTG
gtgctcttggcttggaagat

SEQ ID NO: 11987 - DNA, 20 bp, Artificial Sequence
  Description of Artificial Sequence: Synthetic oligonucleotide
  Target: ANGPTL3; (-) strand; PAM type: YTN; PAM sequence: CTT
ggtgctcttggcttggaaga

SEQ ID NO: 11988 - DNA, 20 bp, Artificial Sequence
  Description of Artificial Sequence: Synthetic oligonucleotide
  Target: ANGPTL3; (-) strand; PAM type: YTN; PAM sequence: TTC
ttggtgctcttggcttggaa

SEQ ID NO: 11989 - DNA, 20 bp, Artificial Sequence
  Description of Artificial Sequence: Synthetic oligonucleotide
  Target: ANGPTL3; (-) strand; PAM type: YTN; PAM sequence: CTG
aagaaagggagtagttcttg

SEQ ID NO: 11990 - DNA, 20 bp, Artificial Sequence
  Description of Artificial Sequence: Synthetic oligonucleotide
  Target: ANGPTL3; (-) strand; PAM type: YTN; PAM sequence: TTC
aactgaagaaagggagtagt

SEQ ID NO: 11991 - DNA, 20 bp, Artificial Sequence
  Description of Artificial Sequence: Synthetic oligonucleotide
  Target: ANGPTL3; (-) strand; PAM type: YTN; PAM sequence: TTC
attcaactgaagaaagggag

SEQ ID NO: 11992 - DNA, 20 bp, Artificial Sequence
  Description of Artificial Sequence: Synthetic oligonucleotide
  Target: ANGPTL3; (-) strand; PAM type: YTN; PAM sequence: TTT
cattcaactgaagaaaggga

SEQ ID NO: 11993 - DNA, 20 bp, Artificial Sequence
  Description of Artificial Sequence: Synthetic oligonucleotide
  Target: ANGPTL3; (-) strand; PAM type: YTN; PAM sequence: TTA
tttcattcaactgaagaaag

SEQ ID NO: 11994 - DNA, 20 bp, Artificial Sequence
  Description of Artificial Sequence: Synthetic oligonucleotide
  Target: ANGPTL3; (-) strand; PAM type: YTN; PAM sequence: CTT
atttcattcaactgaagaaa

SEQ ID NO: 11995 - DNA, 20 bp, Artificial Sequence
  Description of Artificial Sequence: Synthetic oligonucleotide
  Target: ANGPTL3; (-) strand; PAM type: YTN; PAM sequence: TTC
ttatttcattcaactgaaga

SEQ ID NO: 11996 - DNA, 20 bp, Artificial Sequence
  Description of Artificial Sequence: Synthetic oligonucleotide
  Target: ANGPTL3; (-) strand; PAM type: YTN; PAM sequence: TTT
cttatttcattcaactgaag

SEQ ID NO: 11997 - DNA, 20 bp, Artificial Sequence
  Description of Artificial Sequence: Synthetic oligonucleotide
  Target: ANGPTL3; (-) strand; PAM type: YTN; PAM sequence: TTA
catttcttatttcattcaac

SEQ ID NO: 11998 - DNA, 20 bp, Artificial Sequence
  Description of Artificial Sequence: Synthetic oligonucleotide
  Target: ANGPTL3; (-) strand; PAM type: YTN; PAM sequence: TTT
acatttcttatttcattcaa

SEQ ID NO: 11999 - DNA, 20 bp, Artificial Sequence
  Description of Artificial Sequence: Synthetic oligonucleotide
  Target: ANGPTL3; (-) strand; PAM type: YTN; PAM sequence: TTT
tacatttcttatttcattca

SEQ ID NO: 12000 - DNA, 20 bp, Artificial Sequence
  Description of Artificial Sequence: Synthetic oligonucleotide
  Target: ANGPTL3; (-) strand; PAM type: YTN; PAM sequence: TTA
ccatcatgttttacatttct

SEQ ID NO: 12001 - DNA, 20 bp, Artificial Sequence
  Description of Artificial Sequence: Synthetic oligonucleotide
  Target: ANGPTL3; (-) strand; PAM type: YTN; PAM sequence: CTT
accatcatgttttacatttc

SEQ ID NO: 12002 - DNA, 20 bp, Artificial Sequence
  Description of Artificial Sequence: Synthetic oligonucleotide
  Target: ANGPTL3; (-) strand; PAM type: YTN; PAM sequence: TTC
aagaaggaaacccaccaaag

SEQ ID NO: 12003 - DNA, 20 bp, Artificial Sequence
  Description of Artificial Sequence: Synthetic oligonucleotide
  Target: ANGPTL3; (-) strand; PAM type: YTN; PAM sequence: CTT
caagaaggaaacccaccaaa

SEQ ID NO: 12004 - DNA, 20 bp, Artificial Sequence
  Description of Artificial Sequence: Synthetic oligonucleotide
  Target: ANGPTL3; (-) strand; PAM type: YTN; PAM sequence: TTG
ataataatagcttcaagaag

SEQ ID NO: 12005 - DNA, 20 bp, Artificial Sequence
  Description of Artificial Sequence: Synthetic oligonucleotide
  Target: ANGPTL3; (-) strand; PAM type: YTN; PAM sequence: TTT
gataataatagcttcaagaa

SEQ ID NO: 12006 - DNA, 20 bp, Artificial Sequence
  Description of Artificial Sequence: Synthetic oligonucleotide
  Target: ANGPTL3; (-) strand; PAM type: YTN; PAM sequence: CTA
agaatagggaatttgataat

SEQ ID NO: 12007 - DNA, 20 bp, Artificial Sequence
  Description of Artificial Sequence: Synthetic oligonucleotide
  Target: ANGPTL3; (-) strand; PAM type: YTN; PAM sequence: CTA
gaacaagtcctaagaatagg

SEQ ID NO: 12008 - DNA, 20 bp, Artificial Sequence
  Description of Artificial Sequence: Synthetic oligonucleotide
  Target: ANGPTL3; (-) strand; PAM type: YTN; PAM sequence: TTA
gtctagaacaagtcctaaga

SEQ ID NO: 12009 - DNA, 20 bp, Artificial Sequence
  Description of Artificial Sequence: Synthetic oligonucleotide
  Target: ANGPTL3; (-) strand; PAM type: YTN; PAM sequence: TTT
agtctagaacaagtcctaag

SEQ ID NO: 12010 - DNA, 20 bp, Artificial Sequence
  Description of Artificial Sequence: Synthetic oligonucleotide
  Target: ANGPTL3; (-) strand; PAM type: YTN; PAM sequence: TTT
tagtctagaacaagtcctaa

SEQ ID NO: 12011 - DNA, 20 bp, Artificial Sequence
  Description of Artificial Sequence: Synthetic oligonucleotide
  Target: ANGPTL3; (-) strand; PAM type: YTN; PAM sequence: CTT
ttagtctagaacaagtccta

SEQ ID NO: 12012 - DNA, 20 bp, Artificial Sequence
  Description of Artificial Sequence: Synthetic oligonucleotide
  Target: ANGPTL3; (-) strand; PAM type: YTN; PAM sequence: CTA
tcttttagtctagaacaagt

SEQ ID NO: 12013 - DNA, 20 bp, Artificial Sequence
  Description of Artificial Sequence: Synthetic oligonucleotide
  Target: ANGPTL3; (-) strand; PAM type: YTN; PAM sequence: TTA
actatcttttagtctagaac

SEQ ID NO: 12014 - DNA, 20 bp, Artificial Sequence
  Description of Artificial Sequence: Synthetic oligonucleotide
  Target: ANGPTL3; (-) strand; PAM type: YTN; PAM sequence: CTT
aactatcttttagtctagaa

SEQ ID NO: 12015 - DNA, 20 bp, Artificial Sequence
  Description of Artificial Sequence: Synthetic oligonucleotide
  Target: ANGPTL3; (-) strand; PAM type: YTN; PAM sequence: CTC
ttaactatcttttagtctag

SEQ ID NO: 12016 - DNA, 20 bp, Artificial Sequence
  Description of Artificial Sequence: Synthetic oligonucleotide
  Target: ANGPTL3; (-) strand; PAM type: YTN; PAM sequence: TTG
atggatatctcttaactatc

SEQ ID NO: 12017 - DNA, 20 bp, Artificial Sequence
  Description of Artificial Sequence: Synthetic oligonucleotide
  Target: ANGPTL3; (-) strand; PAM type: YTN; PAM sequence: TTT
gatggatatctcttaactat

SEQ ID NO: 12018 - DNA, 20 bp, Artificial Sequence
  Description of Artificial Sequence: Synthetic oligonucleotide
  Target: ANGPTL3; (-) strand; PAM type: YTN; PAM sequence: TTG
tatttgatggatatctctta

SEQ ID NO: 12019 - DNA, 20 bp, Artificial Sequence
  Description of Artificial Sequence: Synthetic oligonucleotide
  Target: ANGPTL3; (-) strand; PAM type: YTN; PAM sequence: TTG
atacattgtatttgatggat

SEQ ID NO: 12020 - DNA, 20 bp, Artificial Sequence
  Description of Artificial Sequence: Synthetic oligonucleotide
  Target: ANGPTL3; (-) strand; PAM type: YTN; PAM sequence: TTA
ggttgatacattgtatttga

SEQ ID NO: 12021 - DNA, 20 bp, Artificial Sequence
  Description of Artificial Sequence: Synthetic oligonucleotide
  Target: ANGPTL3; (-) strand; PAM type: YTN; PAM sequence: TTT
aggttgatacattgtatttg

SEQ ID NO: 12022 - DNA, 20 bp, Artificial Sequence
  Description of Artificial Sequence: Synthetic oligonucleotide
  Target: ANGPTL3; (-) strand; PAM type: YTN; PAM sequence: TTA
tagggtgtaaaaagaacccc

SEQ ID NO: 12023 - DNA, 20 bp, Artificial Sequence
  Description of Artificial Sequence: Synthetic oligonucleotide
  Target: ANGPTL3; (-) strand; PAM type: YTN; PAM sequence: TTT
atagggtgtaaaaagaaccc

SEQ ID NO: 12024 - DNA, 20 bp, Artificial Sequence
  Description of Artificial Sequence: Synthetic oligonucleotide
  Target: ANGPTL3; (-) strand; PAM type: YTN; PAM sequence: TTT
tatagggtgtaaaaagaacc

SEQ ID NO: 12025 - DNA, 20 bp, Artificial Sequence
  Description of Artificial Sequence: Synthetic oligonucleotide
  Target: ANGPTL3; (-) strand; PAM type: YTN; PAM sequence: CTT
ttatagggtgtaaaaagaac

SEQ ID NO: 12026 - DNA, 20 bp, Artificial Sequence
  Description of Artificial Sequence: Synthetic oligonucleotide
  Target: ANGPTL3; (-) strand; PAM type: YTN; PAM sequence: TTA
ggtatgtcttttatagggtg

SEQ ID NO: 12027 - DNA, 20 bp, Artificial Sequence
  Description of Artificial Sequence: Synthetic oligonucleotide
  Target: ANGPTL3; (-) strand; PAM type: YTN; PAM sequence: CTT
aggtatgtcttttatagggt

SEQ ID NO: 12028 - DNA, 20 bp, Artificial Sequence
  Description of Artificial Sequence: Synthetic oligonucleotide
  Target: ANGPTL3; (-) strand; PAM type: YTN; PAM sequence: TTG
tcttaggtatgtcttttata

SEQ ID NO: 12029 - DNA, 20 bp, Artificial Sequence
  Description of Artificial Sequence: Synthetic oligonucleotide
  Target: ANGPTL3; (-) strand; PAM type: YTN; PAM sequence: CTG
attgtcttaggtatgtcttt

SEQ ID NO: 12030 - DNA, 20 bp, Artificial Sequence
  Description of Artificial Sequence: Synthetic oligonucleotide
  Target: ANGPTL3; (-) strand; PAM type: YTN; PAM sequence: CTC
tgattgtcttaggtatgtct

SEQ ID NO: 12031 - DNA, 20 bp, Artificial Sequence
  Description of Artificial Sequence: Synthetic oligonucleotide
  Target: ANGPTL3; (-) strand; PAM type: YTN; PAM sequence: TTC
tctgattgtcttaggtatgt

SEQ ID NO: 12032 - DNA, 20 bp, Artificial Sequence
  Description of Artificial Sequence: Synthetic oligonucleotide
  Target: ANGPTL3; (-) strand; PAM type: YTN; PAM sequence: TTT
ctctgattgtcttaggtatg

SEQ ID NO: 12033 - DNA, 20 bp, Artificial Sequence
  Description of Artificial Sequence: Synthetic oligonucleotide
  Target: ANGPTL3; (-) strand; PAM type: YTN; PAM sequence: TTG
tatttctctgattgtcttag

SEQ ID NO: 12034 - DNA, 20 bp, Artificial Sequence
  Description of Artificial Sequence: Synthetic oligonucleotide
  Target: ANGPTL3; (-) strand; PAM type: YTN; PAM sequence: TTT
gtatttctctgattgtctta

SEQ ID NO: 12035 - DNA, 20 bp, Artificial Sequence
  Description of Artificial Sequence: Synthetic oligonucleotide
  Target: ANGPTL3; (-) strand; PAM type: YTN; PAM sequence: CTA
ataatcaagtccatatttgt

SEQ ID NO: 12036 - DNA, 20 bp, Artificial Sequence
  Description of Artificial Sequence: Synthetic oligonucleotide
  Target: ANGPTL3; (-) strand; PAM type: YTN; PAM sequence: TTA
tctaataatcaagtccatat

SEQ ID NO: 12037 - DNA, 20 bp, Artificial Sequence
  Description of Artificial Sequence: Synthetic oligonucleotide
  Target: ANGPTL3; (-) strand; PAM type: YTN; PAM sequence: CTA
tattatctaataatcaagtc

SEQ ID NO: 12038 - DNA, 20 bp, Artificial Sequence
  Description of Artificial Sequence: Synthetic oligonucleotide
  Target: ANGPTL3; (-) strand; PAM type: YTN; PAM sequence: TTC
tatattatctaataatcaag

SEQ ID NO: 12039 - DNA, 20 bp, Artificial Sequence
  Description of Artificial Sequence: Synthetic oligonucleotide
  Target: ANGPTL3; (-) strand; PAM type: YTN; PAM sequence: CTT
ctatattatctaataatcaa

SEQ ID NO: 12040 - DNA, 20 bp, Artificial Sequence
  Description of Artificial Sequence: Synthetic oligonucleotide
  Target: ANGPTL3; (-) strand; PAM type: YTN; PAM sequence: TTA
ataaaccttctatattatct

SEQ ID NO: 12041 - DNA, 20 bp, Artificial Sequence
  Description of Artificial Sequence: Synthetic oligonucleotide
  Target: ANGPTL3; (-) strand; PAM type: YTN; PAM sequence: CTA
agaaaattaataaaccttct

SEQ ID NO: 12042 - DNA, 20 bp, Artificial Sequence
  Description of Artificial Sequence: Synthetic oligonucleotide
  Target: ANGPTL3; (-) strand; PAM type: YTN; PAM sequence: CTG
caataccatgatcacatcta

SEQ ID NO: 12043 - DNA, 20 bp, Artificial Sequence
  Description of Artificial Sequence: Synthetic oligonucleotide
  Target: ANGPTL3; (-) strand; PAM type: YTN; PAM sequence: TTA
aaactgcaataccatgatca

SEQ ID NO: 12044 - DNA, 20 bp, Artificial Sequence
  Description of Artificial Sequence: Synthetic oligonucleotide
  Target: ANGPTL3; (-) strand; PAM type: YTN; PAM sequence: TTT
aaaactgcaataccatgatc

SEQ ID NO: 12045 - DNA, 20 bp, Artificial Sequence
  Description of Artificial Sequence: Synthetic oligonucleotide
  Target: ANGPTL3; (-) strand; PAM type: YTN; PAM sequence: CTT
taaaactgcaataccatgat

SEQ ID NO: 12046 - DNA, 20 bp, Artificial Sequence
  Description of Artificial Sequence: Synthetic oligonucleotide
  Target: ANGPTL3; (-) strand; PAM type: YTN; PAM sequence: CTC
ctttaaaactgcaataccat

SEQ ID NO: 12047 - DNA, 20 bp, Artificial Sequence
  Description of Artificial Sequence: Synthetic oligonucleotide
  Target: ANGPTL3; (-) strand; PAM type: YTN; PAM sequence: TTC
tcctttaaaactgcaatacc

SEQ ID NO: 12048 - DNA, 20 bp, Artificial Sequence
  Description of Artificial Sequence: Synthetic oligonucleotide
  Target: ANGPTL3; (-) strand; PAM type: YTN; PAM sequence: TTG
ttctcctttaaaactgcaat

SEQ ID NO: 12049 - DNA, 20 bp, Artificial Sequence
  Description of Artificial Sequence: Synthetic oligonucleotide
  Target: ANGPTL3; (-) strand; PAM type: YTN; PAM sequence: TTA
aacaggagattgttctcctt

SEQ ID NO: 12050 - DNA, 20 bp, Artificial Sequence
  Description of Artificial Sequence: Synthetic oligonucleotide
  Target: ANGPTL3; (-) strand; PAM type: YTN; PAM sequence: CTT
aaacaggagattgttctcct

SEQ ID NO: 12051 - DNA, 20 bp, Artificial Sequence
  Description of Artificial Sequence: Synthetic oligonucleotide
  Target: ANGPTL3; (-) strand; PAM type: YTN; PAM sequence: CTC
ttaaacaggagattgttctc

SEQ ID NO: 12052 - DNA, 20 bp, Artificial Sequence
  Description of Artificial Sequence: Synthetic oligonucleotide
  Target: ANGPTL3; (-) strand; PAM type: YTN; PAM sequence: TTC
agcatgtatctcttaaacag

SEQ ID NO: 12053 - DNA, 20 bp, Artificial Sequence
  Description of Artificial Sequence: Synthetic oligonucleotide
  Target: ANGPTL3; (-) strand; PAM type: YTN; PAM sequence: TTT
cagcatgtatctcttaaaca

SEQ ID NO: 12054 - DNA, 20 bp, Artificial Sequence
  Description of Artificial Sequence: Synthetic oligonucleotide
  Target: ANGPTL3; (-) strand; PAM type: YTN; PAM sequence: CTC
cgtaaatatttcagcatgta

SEQ ID NO: 12055 - DNA, 20 bp, Artificial Sequence
  Description of Artificial Sequence: Synthetic oligonucleotide
  Target: ANGPTL3; (-) strand; PAM type: YTN; PAM sequence: TTA
actccgtaaatatttcagca

SEQ ID NO: 12056 - DNA, 20 bp, Artificial Sequence
  Description of Artificial Sequence: Synthetic oligonucleotide
  Target: ANGPTL3; (-) strand; PAM type: YTN; PAM sequence: TTT
aactccgtaaatatttcagc

SEQ ID NO: 12057 - DNA, 20 bp, Artificial Sequence
  Description of Artificial Sequence: Synthetic oligonucleotide
  Target: ANGPTL3; (-) strand; PAM type: YTN; PAM sequence: CTT
taactccgtaaatatttcag

SEQ ID NO: 12058 - DNA, 20 bp, Artificial Sequence
  Description of Artificial Sequence: Synthetic oligonucleotide
  Target: ANGPTL3; (-) strand; PAM type: YTN; PAM sequence: CTG
gagtccagtgacctttaact

SEQ ID NO: 12059 - DNA, 20 bp, Artificial Sequence
  Description of Artificial Sequence: Synthetic oligonucleotide
  Target: ANGPTL3; (-) strand; PAM type: YTN; PAM sequence: CTA
tcaccagtctggagtccagt

SEQ ID NO: 12060 - DNA, 20 bp, Artificial Sequence
  Description of Artificial Sequence: Synthetic oligonucleotide
  Target: ANGPTL3; (-) strand; PAM type: YTN; PAM sequence: TTC
tatcaccagtctggagtcca

SEQ ID NO: 12061 - DNA, 20 bp, Artificial Sequence
  Description of Artificial Sequence: Synthetic oligonucleotide
  Target: ANGPTL3; (-) strand; PAM type: YTN; PAM sequence: TTG
ttctatcaccagtctggagt

SEQ ID NO: 12062 - DNA, 20 bp, Artificial Sequence
  Description of Artificial Sequence: Synthetic oligonucleotide
  Target: ANGPTL3; (-) strand; PAM type: YTN; PAM sequence: CTT
gttctatcaccagtctggag

SEQ ID NO: 12063 - DNA, 20 bp, Artificial Sequence
  Description of Artificial Sequence: Synthetic oligonucleotide
  Target: ANGPTL3; (-) strand; PAM type: YTN; PAM sequence: TTA
gagacagagtcttgttctat

SEQ ID NO: 12064 - DNA, 20 bp, Artificial Sequence
  Description of Artificial Sequence: Synthetic oligonucleotide
  Target: ANGPTL3; (-) strand; PAM type: YTN; PAM sequence: TTT
agagacagagtcttgttcta

SEQ ID NO: 12065 - DNA, 20 bp, Artificial Sequence
  Description of Artificial Sequence: Synthetic oligonucleotide
  Target: ANGPTL3; (-) strand; PAM type: YTN; PAM sequence: TTT
tagagacagagtcttgttct

SEQ ID NO: 12066 - DNA, 20 bp, Artificial Sequence
  Description of Artificial Sequence: Synthetic oligonucleotide
  Target: ANGPTL3; (-) strand; PAM type: YTN; PAM sequence: TTT
ttagagacagagtcttgttc

SEQ ID NO: 12067 - DNA, 20 bp, Artificial Sequence
  Description of Artificial Sequence: Synthetic oligonucleotide
  Target: ANGPTL3; (-) strand; PAM type: YTN; PAM sequence: TTT
tttagagacagagtcttgtt

SEQ ID NO: 12068 - DNA, 20 bp, Artificial Sequence
  Description of Artificial Sequence: Synthetic oligonucleotide
  Target: ANGPTL3; (-) strand; PAM type: YTN; PAM sequence: TTA
ttttttagagacagagtctt

SEQ ID NO: 12069 - DNA, 20 bp, Artificial Sequence
  Description of Artificial Sequence: Synthetic oligonucleotide
  Target: ANGPTL3; (-) strand; PAM type: YTN; PAM sequence: TTA
attattttttagagacagag

SEQ ID NO: 12070 - DNA, 20 bp, Artificial Sequence
  Description of Artificial Sequence: Synthetic oligonucleotide
  Target: ANGPTL3; (-) strand; PAM type: YTN; PAM sequence: TTA
aaaaattaattattttttag

SEQ ID NO: 12071 - DNA, 20 bp, Artificial Sequence
  Description of Artificial Sequence: Synthetic oligonucleotide
  Target: ANGPTL3; (-) strand; PAM type: YTN; PAM sequence: TTT
aaaaaattaattatttttta

SEQ ID NO: 12072 - DNA, 20 bp, Artificial Sequence
  Description of Artificial Sequence: Synthetic oligonucleotide
  Target: ANGPTL3; (-) strand; PAM type: YTN; PAM sequence: TTT
taaaaaattaattatttttt

SEQ ID NO: 12073 - DNA, 20 bp, Artificial Sequence
  Description of Artificial Sequence: Synthetic oligonucleotide
  Target: ANGPTL3; (-) strand; PAM type: YTN; PAM sequence: CTT
ttaaaaaattaattattttt

SEQ ID NO: 12074 - DNA, 20 bp, Artificial Sequence
  Description of Artificial Sequence: Synthetic oligonucleotide
  Target: ANGPTL3; (-) strand; PAM type: YTN; PAM sequence: TTC
ttttaaaaaattaattattt

SEQ ID NO: 12075 - DNA, 20 bp, Artificial Sequence
  Description of Artificial Sequence: Synthetic oligonucleotide
  Target: ANGPTL3; (-) strand; PAM type: YTN; PAM sequence: TTT
cttttaaaaaattaattatt

SEQ ID NO: 12076 - DNA, 20 bp, Artificial Sequence
  Description of Artificial Sequence: Synthetic oligonucleotide
  Target: ANGPTL3; (-) strand; PAM type: YTN; PAM sequence: TTT
tcttttaaaaaattaattat

SEQ ID NO: 12077 - DNA, 20 bp, Artificial Sequence
  Description of Artificial Sequence: Synthetic oligonucleotide
  Target: ANGPTL3; (-) strand; PAM type: YTN; PAM sequence: CTA
ttttcttttaaaaaattaat

SEQ ID NO: 12078 - DNA, 20 bp, Artificial Sequence
  Description of Artificial Sequence: Synthetic oligonucleotide
  Target: ANGPTL3; (-) strand; PAM type: YTN; PAM sequence: TTA
ccaaactattttcttttaaa

SEQ ID NO: 12079 - DNA, 20 bp, Artificial Sequence
  Description of Artificial Sequence: Synthetic oligonucleotide
  Target: ANGPTL3; (-) strand; PAM type: YTN; PAM sequence: CTT
accaaactattttcttttaa

SEQ ID NO: 12080 - DNA, 20 bp, Artificial Sequence
  Description of Artificial Sequence: Synthetic oligonucleotide
  Target: ANGPTL3; (-) strand; PAM type: YTN; PAM sequence: TTA
agaatgtaagaatcatctta

SEQ ID NO: 12081 - DNA, 20 bp, Artificial Sequence
  Description of Artificial Sequence: Synthetic oligonucleotide
  Target: ANGPTL3; (-) strand; PAM type: YTN; PAM sequence: TTT
aagaatgtaagaatcatctt

SEQ ID NO: 12082 - DNA, 20 bp, Artificial Sequence
  Description of Artificial Sequence: Synthetic oligonucleotide
  Target: ANGPTL3; (-) strand; PAM type: YTN; PAM sequence: TTA
tttaagaatgtaagaatcat

SEQ ID NO: 12083 - DNA, 20 bp, Artificial Sequence
  Description of Artificial Sequence: Synthetic oligonucleotide
  Target: ANGPTL3; (-) strand; PAM type: YTN; PAM sequence: TTA
gatggcgtgttatttaagaa

SEQ ID NO: 12084 - DNA, 20 bp, Artificial Sequence
  Description of Artificial Sequence: Synthetic oligonucleotide
  Target: ANGPTL3; (-) strand; PAM type: YTN; PAM sequence: CTT
agatggcgtgttatttaaga

SEQ ID NO: 12085 - DNA, 20 bp, Artificial Sequence
  Description of Artificial Sequence: Synthetic oligonucleotide
  Target: ANGPTL3; (-) strand; PAM type: YTN; PAM sequence: TTC
ttagatggcgtgttatttaa

SEQ ID NO: 12086 - DNA, 20 bp, Artificial Sequence
  Description of Artificial Sequence: Synthetic oligonucleotide
  Target: ANGPTL3; (-) strand; PAM type: YTN; PAM sequence: TTT
cttagatggcgtgttattta

SEQ ID NO: 12087 - DNA, 20 bp, Artificial Sequence
  Description of Artificial Sequence: Synthetic oligonucleotide
  Target: ANGPTL3; (-) strand; PAM type: YTN; PAM sequence: TTT
tcttagatggcgtgttattt

SEQ ID NO: 12088 - DNA, 20 bp, Artificial Sequence
  Description of Artificial Sequence: Synthetic oligonucleotide
  Target: ANGPTL3; (-) strand; PAM type: YTN; PAM sequence: TTT
ttcttagatggcgtgttatt

SEQ ID NO: 12089 - DNA, 20 bp, Artificial Sequence
  Description of Artificial Sequence: Synthetic oligonucleotide
  Target: ANGPTL3; (-) strand; PAM type: YTN; PAM sequence: TTA
aagcatttttcttagatggc

SEQ ID NO: 12090 - DNA, 20 bp, Artificial Sequence
  Description of Artificial Sequence: Synthetic oligonucleotide
  Target: ANGPTL3; (-) strand; PAM type: YTN; PAM sequence: TTA
tgttaaagcatttttcttag

SEQ ID NO: 12091 - DNA, 20 bp, Artificial Sequence
  Description of Artificial Sequence: Synthetic oligonucleotide
  Target: ANGPTL3; (-) strand; PAM type: YTN; PAM sequence: TTT
atgttaaagcatttttctta

SEQ ID NO: 12092 - DNA, 20 bp, Artificial Sequence
  Description of Artificial Sequence: Synthetic oligonucleotide
  Target: ANGPTL3; (-) strand; PAM type: YTN; PAM sequence: TTC
agtaatgtttatgttaaagc

SEQ ID NO: 12093 - DNA, 20 bp, Artificial Sequence
  Description of Artificial Sequence: Synthetic oligonucleotide
  Target: ANGPTL3; (-) strand; PAM type: YTN; PAM sequence: TTT
cagtaatgtttatgttaaag

SEQ ID NO: 12094 - DNA, 20 bp, Artificial Sequence
  Description of Artificial Sequence: Synthetic oligonucleotide
  Target: ANGPTL3; (-) strand; PAM type: YTN; PAM sequence: TTT
tcagtaatgtttatgttaaa

SEQ ID NO: 12095 - DNA, 20 bp, Artificial Sequence
  Description of Artificial Sequence: Synthetic oligonucleotide
  Target: ANGPTL3; (-) strand; PAM type: YTN; PAM sequence: TTT
ttcagtaatgtttatgttaa

SEQ ID NO: 12096 - DNA, 20 bp, Artificial Sequence
  Description of Artificial Sequence: Synthetic oligonucleotide
  Target: ANGPTL3; (-) strand; PAM type: YTN; PAM sequence: TTT
tttcagtaatgtttatgtta

SEQ ID NO: 12097 - DNA, 20 bp, Artificial Sequence
  Description of Artificial Sequence: Synthetic oligonucleotide
  Target: ANGPTL3; (-) strand; PAM type: YTN; PAM sequence: TTG
tggcaaatgtagcatttttt

SEQ ID NO: 12098 - DNA, 20 bp, Artificial Sequence
  Description of Artificial Sequence: Synthetic oligonucleotide
  Target: ANGPTL3; (-) strand; PAM type: YTN; PAM sequence: TTA
tgaagttgtggcaaatgtag

SEQ ID NO: 12099 - DNA, 20 bp, Artificial Sequence
  Description of Artificial Sequence: Synthetic oligonucleotide
  Target: ANGPTL3; (-) strand; PAM type: YTN; PAM sequence: TTT
atgaagttgtggcaaatgta

SEQ ID NO: 12100 - DNA, 20 bp, Artificial Sequence
  Description of Artificial Sequence: Synthetic oligonucleotide
  Target: ANGPTL3; (-) strand; PAM type: YTN; PAM sequence: TTT
tatgaagttgtggcaaatgt

SEQ ID NO: 12101 - DNA, 20 bp, Artificial Sequence
  Description of Artificial Sequence: Synthetic oligonucleotide
  Target: ANGPTL3; (-) strand; PAM type: YTN; PAM sequence: TTG
acattttatgaagttgtggc

SEQ ID NO: 12102 - DNA, 20 bp, Artificial Sequence
  Description of Artificial Sequence: Synthetic oligonucleotide
  Target: ANGPTL3; (-) strand; PAM type: YTN; PAM sequence: CTT
gacattttatgaagttgtgg

SEQ ID NO: 12103 - DNA, 20 bp, Artificial Sequence
  Description of Artificial Sequence: Synthetic oligonucleotide
  Target: ANGPTL3; (-) strand; PAM type: YTN; PAM sequence: TTC
acttgacattttatgaagtt

SEQ ID NO: 12104 - DNA, 20 bp, Artificial Sequence
  Description of Artificial Sequence: Synthetic oligonucleotide
  Target: ANGPTL3; (-) strand; PAM type: YTN; PAM sequence: TTT
cacttgacattttatgaagt

SEQ ID NO: 12105 - DNA, 20 bp, Artificial Sequence
  Description of Artificial Sequence: Synthetic oligonucleotide
  Target: ANGPTL3; (-) strand; PAM type: YTN; PAM sequence: TTG
agatttcacttgacatttta

SEQ ID NO: 12106 - DNA, 20 bp, Artificial Sequence
  Description of Artificial Sequence: Synthetic oligonucleotide
  Target: ANGPTL3; (-) strand; PAM type: YTN; PAM sequence: CTT
gagatttcacttgacatttt

SEQ ID NO: 12107 - DNA, 20 bp, Artificial Sequence
  Description of Artificial Sequence: Synthetic oligonucleotide
  Target: ANGPTL3; (-) strand; PAM type: YTN; PAM sequence: TTG
gagcttgagatttcacttga

SEQ ID NO: 12108 - DNA, 20 bp, Artificial Sequence
  Description of Artificial Sequence: Synthetic oligonucleotide
  Target: ANGPTL3; (-) strand; PAM type: YTN; PAM sequence: TTT
ggagcttgagatttcacttg

SEQ ID NO: 12109 - DNA, 20 bp, Artificial Sequence
  Description of Artificial Sequence: Synthetic oligonucleotide
  Target: ANGPTL3; (-) strand; PAM type: YTN; PAM sequence: CTT
tggagcttgagatttcactt

SEQ ID NO: 12110 - DNA, 20 bp, Artificial Sequence
  Description of Artificial Sequence: Synthetic oligonucleotide
  Target: ANGPTL3; (-) strand; PAM type: YTN; PAM sequence: TTA
gtaataggaataatatcttt

SEQ ID NO: 12111 - DNA, 20 bp, Artificial Sequence
  Description of Artificial Sequence: Synthetic oligonucleotide
  Target: ANGPTL3; (-) strand; PAM type: YTN; PAM sequence: TTT
agtaataggaataatatctt

SEQ ID NO: 12112 - DNA, 20 bp, Artificial Sequence
  Description of Artificial Sequence: Synthetic oligonucleotide
  Target: ANGPTL3; (-) strand; PAM type: YTN; PAM sequence: TTA
catcagatttagtaatagga

SEQ ID NO: 12113 - DNA, 20 bp, Artificial Sequence
  Description of Artificial Sequence: Synthetic oligonucleotide
  Target: ANGPTL3; (-) strand; PAM type: YTN; PAM sequence: TTA
ttacatcagatttagtaata

SEQ ID NO: 12114 - DNA, 20 bp, Artificial Sequence
  Description of Artificial Sequence: Synthetic oligonucleotide
  Target: ANGPTL3; (-) strand; PAM type: YTN; PAM sequence: CTA
gaatcaataaaatgttatta

SEQ ID NO: 12115 - DNA, 20 bp, Artificial Sequence
  Description of Artificial Sequence: Synthetic oligonucleotide
  Target: ANGPTL3; (-) strand; PAM type: YTN; PAM sequence: TTC
agcaggaatgcctagaatca

SEQ ID NO: 12116 - DNA, 20 bp, Artificial Sequence
  Description of Artificial Sequence: Synthetic oligonucleotide
  Target: ANGPTL3; (-) strand; PAM type: YTN; PAM sequence: TTA
taaatggtggtacattcagc

SEQ ID NO: 12117 - DNA, 20 bp, Artificial Sequence
  Description of Artificial Sequence: Synthetic oligonucleotide
  Target: ANGPTL3; (-) strand; PAM type: YTN; PAM sequence: CTG
ttataaatggtggtacattc

SEQ ID NO: 12118 - DNA, 20 bp, Artificial Sequence
  Description of Artificial Sequence: Synthetic oligonucleotide
  Target: ANGPTL3; (-) strand; PAM type: YTN; PAM sequence: CTC
tgttataaatggtggtacat

SEQ ID NO: 12119 - DNA, 20 bp, Artificial Sequence
  Description of Artificial Sequence: Synthetic oligonucleotide
  Target: ANGPTL3; (-) strand; PAM type: YTN; PAM sequence: TTC
acctctgttataaatggtgg

SEQ ID NO: 12120 - DNA, 20 bp, Artificial Sequence
  Description of Artificial Sequence: Synthetic oligonucleotide
  Target: ANGPTL3; (-) strand; PAM type: YTN; PAM sequence: TTG
tatgttcacctctgttataa

SEQ ID NO: 12121 - DNA, 20 bp, Artificial Sequence
  Description of Artificial Sequence: Synthetic oligonucleotide
  Target: ANGPTL3; (-) strand; PAM type: YTN; PAM sequence: CTT
gtatgttcacctctgttata

SEQ ID NO: 12122 - DNA, 20 bp, Artificial Sequence
  Description of Artificial Sequence: Synthetic oligonucleotide
  Target: ANGPTL3; (-) strand; PAM type: YTN; PAM sequence: CTG
atggcatacatgccacttgt

SEQ ID NO: 12123 - DNA, 20 bp, Artificial Sequence
  Description of Artificial Sequence: Synthetic oligonucleotide
  Target: ANGPTL3; (-) strand; PAM type: YTN; PAM sequence: CTG
ggtctgatggcatacatgcc

SEQ ID NO: 12124 - DNA, 20 bp, Artificial Sequence
  Description of Artificial Sequence: Synthetic oligonucleotide
  Target: ANGPTL3; (-) strand; PAM type: YTN; PAM sequence: TTG
ctgggtctgatggcatacat

SEQ ID NO: 12125 - DNA, 20 bp, Artificial Sequence
  Description of Artificial Sequence: Synthetic oligonucleotide
  Target: ANGPTL3; (-) strand; PAM type: YTN; PAM sequence: TTG
agagttgctgggtctgatgg

SEQ ID NO: 12126 - DNA, 20 bp, Artificial Sequence
  Description of Artificial Sequence: Synthetic oligonucleotide
  Target: ANGPTL3; (-) strand; PAM type: YTN; PAM sequence: CTT
gagagttgctgggtctgatg

SEQ ID NO: 12127 - DNA, 20 bp, Artificial Sequence
  Description of Artificial Sequence: Synthetic oligonucleotide
  Target: ANGPTL3; (-) strand; PAM type: YTN; PAM sequence: CTG
atataacatcacagtagaca

SEQ ID NO: 12128 - DNA, 20 bp, Artificial Sequence
  Description of Artificial Sequence: Synthetic oligonucleotide
  Target: ANGPTL3; (-) strand; PAM type: YTN; PAM sequence: TTA
cctgatataacatcacagta

SEQ ID NO: 12129 - DNA, 20 bp, Artificial Sequence
  Description of Artificial Sequence: Synthetic oligonucleotide
  Target: ANGPTL3; (-) strand; PAM type: YTN; PAM sequence: TTT
acctgatataacatcacagt

SEQ ID NO: 12130 - DNA, 20 bp, Artificial Sequence
  Description of Artificial Sequence: Synthetic oligonucleotide
  Target: ANGPTL3; (-) strand; PAM type: YTN; PAM sequence: TTT
tacctgatataacatcacag

SEQ ID NO: 12131 - DNA, 20 bp, Artificial Sequence
  Description of Artificial Sequence: Synthetic oligonucleotide
  Target: ANGPTL3; (-) strand; PAM type: YTN; PAM sequence: TTA
gacaggttttacctgatata

SEQ ID NO: 12132 - DNA, 20 bp, Artificial Sequence
  Description of Artificial Sequence: Synthetic oligonucleotide
  Target: ANGPTL3; (-) strand; PAM type: YTN; PAM sequence: CTT
agacaggttttacctgatat

SEQ ID NO: 12133 - DNA, 20 bp, Artificial Sequence
  Description of Artificial Sequence: Synthetic oligonucleotide
  Target: ANGPTL3; (-) strand; PAM type: YTN; PAM sequence: CTC
cttagacaggttttacctga

SEQ ID NO: 12134 - DNA, 20 bp, Artificial Sequence
  Description of Artificial Sequence: Synthetic oligonucleotide
  Target: ANGPTL3; (-) strand; PAM type: YTN; PAM sequence: TTC
tccttagacaggttttacct

SEQ ID NO: 12135 - DNA, 20 bp, Artificial Sequence
  Description of Artificial Sequence: Synthetic oligonucleotide
  Target: ANGPTL3; (-) strand; PAM type: YTN; PAM sequence: CTA
ttctccttagacaggtttta

SEQ ID NO: 12136 - DNA, 20 bp, Artificial Sequence
  Description of Artificial Sequence: Synthetic oligonucleotide
  Target: ANGPTL3; (-) strand; PAM type: YTN; PAM sequence: CTG
tctattctccttagacaggt

SEQ ID NO: 12137 - DNA, 20 bp, Artificial Sequence
  Description of Artificial Sequence: Synthetic oligonucleotide
  Target: ANGPTL3; (-) strand; PAM type: YTN; PAM sequence: CTA
ctgtctattctccttagaca

SEQ ID NO: 12138 - DNA, 20 bp, Artificial Sequence
  Description of Artificial Sequence: Synthetic oligonucleotide
  Target: ANGPTL3; (-) strand; PAM type: YTN; PAM sequence: CTA
actactgtctattctcctta

SEQ ID NO: 12139 - DNA, 20 bp, Artificial Sequence
  Description of Artificial Sequence: Synthetic oligonucleotide
  Target: ANGPTL3; (-) strand; PAM type: YTN; PAM sequence: TTG
aactaactactgtctattct

SEQ ID NO: 12140 - DNA, 20 bp, Artificial Sequence
  Description of Artificial Sequence: Synthetic oligonucleotide
  Target: ANGPTL3; (-) strand; PAM type: YTN; PAM sequence: CTA
atacgtaatgagtaagttga

SEQ ID NO: 12141 - DNA, 20 bp, Artificial Sequence
  Description of Artificial Sequence: Synthetic oligonucleotide
  Target: ANGPTL3; (-) strand; PAM type: YTN; PAM sequence: TTC
ctaatacgtaatgagtaagt

SEQ ID NO: 12142 - DNA, 20 bp, Artificial Sequence
  Description of Artificial Sequence: Synthetic oligonucleotide
  Target: ANGPTL3; (-) strand; PAM type: YTN; PAM sequence: CTT
cctaatacgtaatgagtaag

SEQ ID NO: 12143 - DNA, 20 bp, Artificial Sequence
  Description of Artificial Sequence: Synthetic oligonucleotide
  Target: ANGPTL3; (-) strand; PAM type: YTN; PAM sequence: TTA
atcttcctaatacgtaatga

SEQ ID NO: 12144 - DNA, 20 bp, Artificial Sequence
  Description of Artificial Sequence: Synthetic oligonucleotide
  Target: ANGPTL3; (-) strand; PAM type: YTN; PAM sequence: TTC
atatatatatgtataaaaca

SEQ ID NO: 12145 - DNA, 20 bp, Artificial Sequence
  Description of Artificial Sequence: Synthetic oligonucleotide
  Target: ANGPTL3; (-) strand; PAM type: YTN; PAM sequence: TTT
catatatatatgtataaaac

SEQ ID NO: 12146 - DNA, 20 bp, Artificial Sequence
  Description of Artificial Sequence: Synthetic oligonucleotide
  Target: ANGPTL3; (-) strand; PAM type: YTN; PAM sequence: CTC
atatatatttcatatatata

SEQ ID NO: 12147 - DNA, 20 bp, Artificial Sequence
  Description of Artificial Sequence: Synthetic oligonucleotide
  Target: ANGPTL3; (-) strand; PAM type: YTN; PAM sequence: TTA
tacgaatactcatatatatt

SEQ ID NO: 12148 - DNA, 20 bp, Artificial Sequence
  Description of Artificial Sequence: Synthetic oligonucleotide
  Target: ANGPTL3; (-) strand; PAM type: YTN; PAM sequence: TTT
atacgaatactcatatatat

SEQ ID NO: 12149 - DNA, 20 bp, Artificial Sequence
  Description of Artificial Sequence: Synthetic oligonucleotide
  Target: ANGPTL3; (-) strand; PAM type: YTN; PAM sequence: TTA
tatttatacgaatactcata

SEQ ID NO: 12150 - DNA, 20 bp, Artificial Sequence
  Description of Artificial Sequence: Synthetic oligonucleotide
  Target: ANGPTL3; (-) strand; PAM type: YTN; PAM sequence: TTG
agtaaatacataaacaaggt

SEQ ID NO: 12151 - DNA, 20 bp, Artificial Sequence
  Description of Artificial Sequence: Synthetic oligonucleotide
  Target: ANGPTL3; (-) strand; PAM type: YTN; PAM sequence: TTA
gaggaaaaggagaatattga

SEQ ID NO: 12152 - DNA, 20 bp, Artificial Sequence
  Description of Artificial Sequence: Synthetic oligonucleotide
  Target: ANGPTL3; (-) strand; PAM type: YTN; PAM sequence: TTT
agaggaaaaggagaatattg

SEQ ID NO: 12153 - DNA, 20 bp, Artificial Sequence
  Description of Artificial Sequence: Synthetic oligonucleotide
  Target: ANGPTL3; (-) strand; PAM type: YTN; PAM sequence: TTT
tagaggaaaaggagaatatt

SEQ ID NO: 12154 - DNA, 20 bp, Artificial Sequence
  Description of Artificial Sequence: Synthetic oligonucleotide
  Target: ANGPTL3; (-) strand; PAM type: YTN; PAM sequence: TTA
ttttagaggaaaaggagaat

SEQ ID NO: 12155 - DNA, 20 bp, Artificial Sequence
  Description of Artificial Sequence: Synthetic oligonucleotide
  Target: ANGPTL3; (-) strand; PAM type: YTN; PAM sequence: TTC
agattattttagaggaaaag

SEQ ID NO: 12156 - DNA, 20 bp, Artificial Sequence
  Description of Artificial Sequence: Synthetic oligonucleotide
  Target: ANGPTL3; (-) strand; PAM type: YTN; PAM sequence: CTT
cagattattttagaggaaaa

SEQ ID NO: 12157 - DNA, 20 bp, Artificial Sequence
  Description of Artificial Sequence: Synthetic oligonucleotide
  Target: ANGPTL3; (-) strand; PAM type: YTN; PAM sequence: TTG
ataatagtcacttcagatta

SEQ ID NO: 12158 - DNA, 20 bp, Artificial Sequence
  Description of Artificial Sequence: Synthetic oligonucleotide
  Target: ANGPTL3; (-) strand; PAM type: YTN; PAM sequence: TTA
ttgataatagtcacttcaga

SEQ ID NO: 12159 - DNA, 20 bp, Artificial Sequence
  Description of Artificial Sequence: Synthetic oligonucleotide
  Target: ANGPTL3; (-) strand; PAM type: YTN; PAM sequence: CTT
attgataatagtcacttcag

SEQ ID NO: 12160 - DNA, 20 bp, Artificial Sequence
  Description of Artificial Sequence: Synthetic oligonucleotide
  Target: ANGPTL3; (-) strand; PAM type: YTN; PAM sequence: TTG
gcatagtaaacttattgata

SEQ ID NO: 12161 - DNA, 20 bp, Artificial Sequence
  Description of Artificial Sequence: Synthetic oligonucleotide
  Target: ANGPTL3; (-) strand; PAM type: YTN; PAM sequence: TTT
ggcatagtaaacttattgat

SEQ ID NO: 12162 - DNA, 20 bp, Artificial Sequence
  Description of Artificial Sequence: Synthetic oligonucleotide
  Target: ANGPTL3; (-) strand; PAM type: YTN; PAM sequence: TTT
tggcatagtaaacttattga

SEQ ID NO: 12163 - DNA, 20 bp, Artificial Sequence
  Description of Artificial Sequence: Synthetic oligonucleotide
  Target: ANGPTL3; (-) strand; PAM type: YTN; PAM sequence: TTA
atgaattttggcatagtaaa

SEQ ID NO: 12164 - DNA, 20 bp, Artificial Sequence
  Description of Artificial Sequence: Synthetic oligonucleotide
  Target: ANGPTL3; (-) strand; PAM type: YTN; PAM sequence: TTA
agtgaaaggcaattaatgaa

SEQ ID NO: 12165 - DNA, 20 bp, Artificial Sequence
  Description of Artificial Sequence: Synthetic oligonucleotide
  Target: ANGPTL3; (-) strand; PAM type: YTN; PAM sequence: TTA
tggtcccaaaagttaagtga

SEQ ID NO: 12166 - DNA, 20 bp, Artificial Sequence
  Description of Artificial Sequence: Synthetic oligonucleotide
  Target: ANGPTL3; (-) strand; PAM type: YTN; PAM sequence: TTA
ttatggtcccaaaagttaag

SEQ ID NO: 12167 - DNA, 20 bp, Artificial Sequence
  Description of Artificial Sequence: Synthetic oligonucleotide
  Target: ANGPTL3; (-) strand; PAM type: YTN; PAM sequence: TTT
attatggtcccaaaagttaa

SEQ ID NO: 12168 - DNA, 20 bp, Artificial Sequence
  Description of Artificial Sequence: Synthetic oligonucleotide
  Target: ANGPTL3; (-) strand; PAM type: YTN; PAM sequence: TTA
tttattatggtcccaaaagt

SEQ ID NO: 12169 - DNA, 20 bp, Artificial Sequence
  Description of Artificial Sequence: Synthetic oligonucleotide
  Target: ANGPTL3; (-) strand; PAM type: YTN; PAM sequence: TTA
ttatttattatggtcccaaa

SEQ ID NO: 12170 - DNA, 20 bp, Artificial Sequence
  Description of Artificial Sequence: Synthetic oligonucleotide
  Target: ANGPTL3; (-) strand; PAM type: YTN; PAM sequence: TTT
attatttattatggtcccaa

SEQ ID NO: 12171 - DNA, 20 bp, Artificial Sequence
  Description of Artificial Sequence: Synthetic oligonucleotide
  Target: ANGPTL3; (-) strand; PAM type: YTN; PAM sequence: TTT
tattatttattatggtccca

SEQ ID NO: 12172 - DNA, 20 bp, Artificial Sequence
  Description of Artificial Sequence: Synthetic oligonucleotide
  Target: ANGPTL3; (-) strand; PAM type: YTN; PAM sequence: TTA
tggcaatacattttattatt

SEQ ID NO: 12173 - DNA, 20 bp, Artificial Sequence
  Description of Artificial Sequence: Synthetic oligonucleotide
  Target: ANGPTL3; (-) strand; PAM type: YTN; PAM sequence: TTA
atgttatggcaatacatttt

SEQ ID NO: 12174 - DNA, 20 bp, Artificial Sequence
  Description of Artificial Sequence: Synthetic oligonucleotide
  Target: ANGPTL3; (-) strand; PAM type: YTN; PAM sequence: TTA
ttaatgttatggcaatacat

SEQ ID NO: 12175 - DNA, 20 bp, Artificial Sequence
  Description of Artificial Sequence: Synthetic oligonucleotide
  Target: ANGPTL3; (-) strand; PAM type: YTN; PAM sequence: TTT
attaatgttatggcaataca

SEQ ID NO: 12176 - DNA, 20 bp, Artificial Sequence
  Description of Artificial Sequence: Synthetic oligonucleotide
  Target: ANGPTL3; (-) strand; PAM type: YTN; PAM sequence: TTG
taaggtagtttattaatgtt

SEQ ID NO: 12177 - DNA, 20 bp, Artificial Sequence
  Description of Artificial Sequence: Synthetic oligonucleotide
  Target: ANGPTL3; (-) strand; PAM type: YTN; PAM sequence: TTT
gtaaggtagtttattaatgt

SEQ ID NO: 12178 - DNA, 20 bp, Artificial Sequence
  Description of Artificial Sequence: Synthetic oligonucleotide
  Target: ANGPTL3; (-) strand; PAM type: YTN; PAM sequence: TTT
tgtaaggtagtttattaatg

SEQ ID NO: 12179 - DNA, 20 bp, Artificial Sequence
  Description of Artificial Sequence: Synthetic oligonucleotide
  Target: ANGPTL3; (-) strand; PAM type: YTN; PAM sequence: TTG
gtggttttgtaaggtagttt

SEQ ID NO: 12180 - DNA, 20 bp, Artificial Sequence
  Description of Artificial Sequence: Synthetic oligonucleotide
  Target: ANGPTL3; (-) strand; PAM type: YTN; PAM sequence: TTA
attggtggttttgtaaggta

SEQ ID NO: 12181 - DNA, 20 bp, Artificial Sequence
  Description of Artificial Sequence: Synthetic oligonucleotide
  Target: ANGPTL3; (-) strand; PAM type: YTN; PAM sequence: TTT
aattggtggttttgtaaggt

SEQ ID NO: 12182 - DNA, 20 bp, Artificial Sequence
  Description of Artificial Sequence: Synthetic oligonucleotide
  Target: ANGPTL3; (-) strand; PAM type: YTN; PAM sequence: TTT
taattggtggttttgtaagg

SEQ ID NO: 12183 - DNA, 20 bp, Artificial Sequence
  Description of Artificial Sequence: Synthetic oligonucleotide
  Target: ANGPTL3; (-) strand; PAM type: YTN; PAM sequence: TTG
attttaattggtggttttgt

SEQ ID NO: 12184 - DNA, 20 bp, Artificial Sequence
  Description of Artificial Sequence: Synthetic oligonucleotide
  Target: ANGPTL3; (-) strand; PAM type: YTN; PAM sequence: TTT
gattttaattggtggttttg

SEQ ID NO: 12185 - DNA, 20 bp, Artificial Sequence
  Description of Artificial Sequence: Synthetic oligonucleotide
  Target: ANGPTL3; (-) strand; PAM type: YTN; PAM sequence: TTG
tttgattttaattggtggtt

SEQ ID NO: 12186 - DNA, 20 bp, Artificial Sequence
  Description of Artificial Sequence: Synthetic oligonucleotide
  Target: ANGPTL3; (-) strand; PAM type: YTN; PAM sequence: TTT
gtttgattttaattggtggt

SEQ ID NO: 12187 - DNA, 20 bp, Artificial Sequence
  Description of Artificial Sequence: Synthetic oligonucleotide
  Target: ANGPTL3; (-) strand; PAM type: YTN; PAM sequence: TTG
tttgtttgattttaattggt

SEQ ID NO: 12188 - DNA, 20 bp, Artificial Sequence
  Description of Artificial Sequence: Synthetic oligonucleotide
  Target: ANGPTL3; (-) strand; PAM type: YTN; PAM sequence: TTT
gtttgtttgattttaattgg

SEQ ID NO: 12189 - DNA, 20 bp, Artificial Sequence
  Description of Artificial Sequence: Synthetic oligonucleotide
  Target: ANGPTL3; (-) strand; PAM type: YTN; PAM sequence: TTT
tgtttgtttgattttaattg

SEQ ID NO: 12190 - DNA, 20 bp, Artificial Sequence
  Description of Artificial Sequence: Synthetic oligonucleotide
  Target: ANGPTL3; (-) strand; PAM type: YTN; PAM sequence: TTT
ttgtttgtttgattttaatt

SEQ ID NO: 12191 - DNA, 20 bp, Artificial Sequence
  Description of Artificial Sequence: Synthetic oligonucleotide
  Target: ANGPTL3; (-) strand; PAM type: YTN; PAM sequence: TTT
tttgtttgtttgattttaat

SEQ ID NO: 12192 - DNA, 20 bp, Artificial Sequence
  Description of Artificial Sequence: Synthetic oligonucleotide
  Target: ANGPTL3; (-) strand; PAM type: YTN; PAM sequence: CTT
ttttgtttgtttgattttaa

SEQ ID NO: 12193 - DNA, 20 bp, Artificial Sequence
  Description of Artificial Sequence: Synthetic oligonucleotide
  Target: ANGPTL3; (-) strand; PAM type: YTN; PAM sequence: TTG
acagatgtaaataacacttt

SEQ ID NO: 12194 - DNA, 20 bp, Artificial Sequence
  Description of Artificial Sequence: Synthetic oligonucleotide
  Target: ANGPTL3; (-) strand; PAM type: YTN; PAM sequence: TTA
tgttgacagatgtaaataac

SEQ ID NO: 12195 - DNA, 20 bp, Artificial Sequence
  Description of Artificial Sequence: Synthetic oligonucleotide
  Target: ANGPTL3; (-) strand; PAM type: YTN; PAM sequence: TTT
atgttgacagatgtaaataa

SEQ ID NO: 12196 - DNA, 20 bp, Artificial Sequence
  Description of Artificial Sequence: Synthetic oligonucleotide
  Target: ANGPTL3; (-) strand; PAM type: YTN; PAM sequence: TTA
gtagatttatgttgacagat

SEQ ID NO: 12197 - DNA, 20 bp, Artificial Sequence
  Description of Artificial Sequence: Synthetic oligonucleotide
  Target: ANGPTL3; (-) strand; PAM type: YTN; PAM sequence: TTT
agtagatttatgttgacaga

SEQ ID NO: 12198 - DNA, 20 bp, Artificial Sequence
  Description of Artificial Sequence: Synthetic oligonucleotide
  Target: ANGPTL3; (-) strand; PAM type: YTN; PAM sequence: TTT
tagtagatttatgttgacag

SEQ ID NO: 12199 - DNA, 20 bp, Artificial Sequence
  Description of Artificial Sequence: Synthetic oligonucleotide
  Target: ANGPTL3; (-) strand; PAM type: YTN; PAM sequence: TTT
ttagtagatttatgttgaca

SEQ ID NO: 12200 - DNA, 20 bp, Artificial Sequence
  Description of Artificial Sequence: Synthetic oligonucleotide
  Target: ANGPTL3; (-) strand; PAM type: YTN; PAM sequence: CTG
aatataatgaatgaaatcat

SEQ ID NO: 12201 - DNA, 20 bp, Artificial Sequence
  Description of Artificial Sequence: Synthetic oligonucleotide
  Target: ANGPTL3; (-) strand; PAM type: YTN; PAM sequence: CTA
cctgaatataatgaatgaaa

SEQ ID NO: 12202 - DNA, 20 bp, Artificial Sequence
  Description of Artificial Sequence: Synthetic oligonucleotide
  Target: ANGPTL3; (-) strand; PAM type: YTN; PAM sequence: TTA
atgtccatggactacctgaa

SEQ ID NO: 12203 - DNA, 20 bp, Artificial Sequence
  Description of Artificial Sequence: Synthetic oligonucleotide
  Target: ANGPTL3; (-) strand; PAM type: YTN; PAM sequence: TTG
aattaatgtccatggactac

SEQ ID NO: 12204 - DNA, 20 bp, Artificial Sequence
  Description of Artificial Sequence: Synthetic oligonucleotide
  Target: ANGPTL3; (-) strand; PAM type: YTN; PAM sequence: TTC
gatgttgaattaatgtccat

SEQ ID NO: 12205 - DNA, 20 bp, Artificial Sequence
  Description of Artificial Sequence: Synthetic oligonucleotide
  Target: ANGPTL3; (-) strand; PAM type: YTN; PAM sequence: CTA
ttcgatgttgaattaatgtc

SEQ ID NO: 12206 - DNA, 20 bp, Artificial Sequence
  Description of Artificial Sequence: Synthetic oligonucleotide
  Target: ANGPTL3; (-) strand; PAM type: YTN; PAM sequence: TTG
tgatccatctattcgatgtt

SEQ ID NO: 12207 - DNA, 20 bp, Artificial Sequence
  Description of Artificial Sequence: Synthetic oligonucleotide
  Target: ANGPTL3; (-) strand; PAM type: YTN; PAM sequence: TTT
gtgatccatctattcgatgt

SEQ ID NO: 12208 - DNA, 20 bp, Artificial Sequence
  Description of Artificial Sequence: Synthetic oligonucleotide
  Target: ANGPTL3; (-) strand; PAM type: YTN; PAM sequence: TTT
tgtgatccatctattcgatg

SEQ ID NO: 12209 - DNA, 20 bp, Artificial Sequence
  Description of Artificial Sequence: Synthetic oligonucleotide
  Target: ANGPTL3; (-) strand; PAM type: YTN; PAM sequence: TTG
aagttttgtgatccatctat

SEQ ID NO: 12210 - DNA, 20 bp, Artificial Sequence
  Description of Artificial Sequence: Synthetic oligonucleotide
  Target: ANGPTL3; (-) strand; PAM type: YTN; PAM sequence: TTC
attgaagttttgtgatccat

SEQ ID NO: 12211 - DNA, 20 bp, Artificial Sequence
  Description of Artificial Sequence: Synthetic oligonucleotide
  Target: ANGPTL3; (-) strand; PAM type: YTN; PAM sequence: TTT
cattgaagttttgtgatcca

SEQ ID NO: 12212 - DNA, 20 bp, Artificial Sequence
  Description of Artificial Sequence: Synthetic oligonucleotide
  Target: ANGPTL3; (-) strand; PAM type: YTN; PAM sequence: CTC
ccacgtttcattgaagtttt

SEQ ID NO: 12213 - DNA, 20 bp, Artificial Sequence
  Description of Artificial Sequence: Synthetic oligonucleotide
  Target: ANGPTL3; (-) strand; PAM type: YTN; PAM sequence: TTC
tcccacgtttcattgaagtt

SEQ ID NO: 12214 - DNA, 20 bp, Artificial Sequence
  Description of Artificial Sequence: Synthetic oligonucleotide
  Target: ANGPTL3; (-) strand; PAM type: YTN; PAM sequence: TTG
tagttctcccacgtttcatt

SEQ ID NO: 12215 - DNA, 20 bp, Artificial Sequence
  Description of Artificial Sequence: Synthetic oligonucleotide
  Target: ANGPTL3; (-) strand; PAM type: YTN; PAM sequence: TTT
gtagttctcccacgtttcat

SEQ ID NO: 12216 - DNA, 20 bp, Artificial Sequence
  Description of Artificial Sequence: Synthetic oligonucleotide
  Target: ANGPTL3; (-) strand; PAM type: YTN; PAM sequence: CTC
ccaaaaccatatttgtagtt

SEQ ID NO: 12217 - DNA, 20 bp, Artificial Sequence
  Description of Artificial Sequence: Synthetic oligonucleotide
  Target: ANGPTL3; (-) strand; PAM type: YTN; PAM sequence: TTA
ccatcaagcctcccaaaacc

SEQ ID NO: 12218 - DNA, 20 bp, Artificial Sequence
  Description of Artificial Sequence: Synthetic oligonucleotide
  Target: ANGPTL3; (-) strand; PAM type: YTN; PAM sequence: CTT
accatcaagcctcccaaaac

SEQ ID NO: 12219 - DNA, 20 bp, Artificial Sequence
  Description of Artificial Sequence: Synthetic oligonucleotide
  Target: ANGPTL3; (-) strand; PAM type: YTN; PAM sequence: TTG
aatgtagtccccttaccatc

SEQ ID NO: 12220 - DNA, 20 bp, Artificial Sequence
  Description of Artificial Sequence: Synthetic oligonucleotide
  Target: ANGPTL3; (-) strand; PAM type: YTN; PAM sequence: TTA
gcaagtgaatgaatgattga

SEQ ID NO: 12221 - DNA, 20 bp, Artificial Sequence
  Description of Artificial Sequence: Synthetic oligonucleotide
  Target: ANGPTL3; (-) strand; PAM type: YTN; PAM sequence: TTG
tagattagcaagtgaatgaa

SEQ ID NO: 12222 - DNA, 20 bp, Artificial Sequence
  Description of Artificial Sequence: Synthetic oligonucleotide
  Target: ANGPTL3; (-) strand; PAM type: YTN; PAM sequence: TTT
gtagattagcaagtgaatga

SEQ ID NO: 12223 - DNA, 20 bp, Artificial Sequence
  Description of Artificial Sequence: Synthetic oligonucleotide
  Target: ANGPTL3; (-) strand; PAM type: YTN; PAM sequence: CTC
agtaaatatttgtagattag

SEQ ID NO: 12224 - DNA, 20 bp, Artificial Sequence
  Description of Artificial Sequence: Synthetic oligonucleotide
  Target: ANGPTL3; (-) strand; PAM type: YTN; PAM sequence: TTC
tcagtaaatatttgtagatt

SEQ ID NO: 12225 - DNA, 20 bp, Artificial Sequence
  Description of Artificial Sequence: Synthetic oligonucleotide
  Target: ANGPTL3; (-) strand; PAM type: YTN; PAM sequence: CTG
gtccataagaggttctcagt

SEQ ID NO: 12226 - DNA, 20 bp, Artificial Sequence
  Description of Artificial Sequence: Synthetic oligonucleotide
  Target: ANGPTL3; (-) strand; PAM type: YTN; PAM sequence: CTA
atacctggtccataagaggt

SEQ ID NO: 12227 - DNA, 20 bp, Artificial Sequence
  Description of Artificial Sequence: Synthetic oligonucleotide
  Target: ANGPTL3; (-) strand; PAM type: YTN; PAM sequence: TTC
ctaatacctggtccataaga

SEQ ID NO: 12228 - DNA, 20 bp, Artificial Sequence
  Description of Artificial Sequence: Synthetic oligonucleotide
  Target: ANGPTL3; (-) strand; PAM type: YTN; PAM sequence: TTT
cctaatacctggtccataag

SEQ ID NO: 12229 - DNA, 20 bp, Artificial Sequence
  Description of Artificial Sequence: Synthetic oligonucleotide
  Target: ANGPTL3; (-) strand; PAM type: YTN; PAM sequence: TTT
tcctaatacctggtccataa

SEQ ID NO: 12230 - DNA, 20 bp, Artificial Sequence
  Description of Artificial Sequence: Synthetic oligonucleotide
  Target: ANGPTL3; (-) strand; PAM type: YTN; PAM sequence: CTT
ttcctaatacctggtccata

SEQ ID NO: 12231 - DNA, 20 bp, Artificial Sequence
  Description of Artificial Sequence: Synthetic oligonucleotide
  Target: ANGPTL3; (-) strand; PAM type: YTN; PAM sequence: CTA
cttttcctaatacctggtcc

SEQ ID NO: 12232 - DNA, 20 bp, Artificial Sequence
  Description of Artificial Sequence: Synthetic oligonucleotide
  Target: ANGPTL3; (-) strand; PAM type: YTN; PAM sequence: TTA
ctacttttcctaatacctgg

SEQ ID NO: 12233 - DNA, 20 bp, Artificial Sequence
  Description of Artificial Sequence: Synthetic oligonucleotide
  Target: ANGPTL3; (-) strand; PAM type: YTN; PAM sequence: TTC
gttactacttttcctaatac

SEQ ID NO: 12234 - DNA, 20 bp, Artificial Sequence
  Description of Artificial Sequence: Synthetic oligonucleotide
  Target: ANGPTL3; (-) strand; PAM type: YTN; PAM sequence: CTC
gttcgttactacttttccta

SEQ ID NO: 12235 - DNA, 20 bp, Artificial Sequence
  Description of Artificial Sequence: Synthetic oligonucleotide
  Target: ANGPTL3; (-) strand; PAM type: YTN; PAM sequence: TTC
tcgttcgttactacttttcc

SEQ ID NO: 12236 - DNA, 20 bp, Artificial Sequence
  Description of Artificial Sequence: Synthetic oligonucleotide
  Target: ANGPTL3; (-) strand; PAM type: YTN; PAM sequence: CTT
ctcgttcgttactacttttc

SEQ ID NO: 12237 - DNA, 20 bp, Artificial Sequence
  Description of Artificial Sequence: Synthetic oligonucleotide
  Target: ANGPTL3; (-) strand; PAM type: YTN; PAM sequence: CTG
cttctcgttcgttactactt

SEQ ID NO: 12238 - DNA, 20 bp, Artificial Sequence
  Description of Artificial Sequence: Synthetic oligonucleotide
  Target: ANGPTL3; (-) strand; PAM type: YTN; PAM sequence: CTG
agactgcttctcgttcgtta

SEQ ID NO: 12239 - DNA, 20 bp, Artificial Sequence
  Description of Artificial Sequence: Synthetic oligonucleotide
  Target: ANGPTL3; (-) strand; PAM type: YTN; PAM sequence: TTA
tatgaaggctgagactgctt

SEQ ID NO: 12240 - DNA, 20 bp, Artificial Sequence
  Description of Artificial Sequence: Synthetic oligonucleotide
  Target: ANGPTL3; (-) strand; PAM type: YTN; PAM sequence: TTG
ataataaattatatgaaggc

SEQ ID NO: 12241 - DNA, 20 bp, Artificial Sequence
  Description of Artificial Sequence: Synthetic oligonucleotide
  Target: ANGPTL3; (-) strand; PAM type: YTN; PAM sequence: TTT
gataataaattatatgaagg

SEQ ID NO: 12242 - DNA, 20 bp, Artificial Sequence
  Description of Artificial Sequence: Synthetic oligonucleotide
  Target: ANGPTL3; (-) strand; PAM type: YTN; PAM sequence: TTG
tttgataataaattatatga

SEQ ID NO: 12243 - DNA, 20 bp, Artificial Sequence
  Description of Artificial Sequence: Synthetic oligonucleotide
  Target: ANGPTL3; (-) strand; PAM type: YTN; PAM sequence: CTA
acaaatgtgtaattgtttga

SEQ ID NO: 12244 - DNA, 20 bp, Artificial Sequence
  Description of Artificial Sequence: Synthetic oligonucleotide
  Target: ANGPTL3; (-) strand; PAM type: YTN; PAM sequence: TTA
ctaacaaatgtgtaattgtt

SEQ ID NO: 12245 - DNA, 20 bp, Artificial Sequence
  Description of Artificial Sequence: Synthetic oligonucleotide
  Target: ANGPTL3; (-) strand; PAM type: YTN; PAM sequence: TTT
actaacaaatgtgtaattgt

SEQ ID NO: 12246 - DNA, 20 bp, Artificial Sequence
  Description of Artificial Sequence: Synthetic oligonucleotide
  Target: ANGPTL3; (-) strand; PAM type: YTN; PAM sequence: TTG
taataagtgtaatttactaa

SEQ ID NO: 12247 - DNA, 20 bp, Artificial Sequence
  Description of Artificial Sequence: Synthetic oligonucleotide
  Target: ANGPTL3; (-) strand; PAM type: YTN; PAM sequence: TTC
aaataataacagttgtaata

SEQ ID NO: 12248 - DNA, 20 bp, Artificial Sequence
  Description of Artificial Sequence: Synthetic oligonucleotide
  Target: ANGPTL3; (-) strand; PAM type: YTN; PAM sequence: TTG
tgataaatataattcaaata

SEQ ID NO: 12249 - DNA, 20 bp, Artificial Sequence
  Description of Artificial Sequence: Synthetic oligonucleotide
  Target: ANGPTL3; (-) strand; PAM type: YTN; PAM sequence: TTA
agaacagacatgtaattgtg

SEQ ID NO: 12250 - DNA, 20 bp, Artificial Sequence
  Description of Artificial Sequence: Synthetic oligonucleotide
  Target: ANGPTL3; (-) strand; PAM type: YTN; PAM sequence: TTT
aagaacagacatgtaattgt

SEQ ID NO: 12251 - DNA, 20 bp, Artificial Sequence
  Description of Artificial Sequence: Synthetic oligonucleotide
  Target: ANGPTL3; (-) strand; PAM type: YTN; PAM sequence: TTG
tgataagtatatttaagaac

SEQ ID NO: 12252 - DNA, 20 bp, Artificial Sequence
  Description of Artificial Sequence: Synthetic oligonucleotide
  Target: ANGPTL3; (-) strand; PAM type: YTN; PAM sequence: TTA
aattgtgataagtatattta

SEQ ID NO: 12253 - DNA, 20 bp, Artificial Sequence
  Description of Artificial Sequence: Synthetic oligonucleotide
  Target: ANGPTL3; (-) strand; PAM type: YTN; PAM sequence: TTG
taagccgtggaattaaattg

SEQ ID NO: 12254 - DNA, 20 bp, Artificial Sequence
  Description of Artificial Sequence: Synthetic oligonucleotide
  Target: ANGPTL3; (-) strand; PAM type: YTN; PAM sequence: TTA
tgatcattgtaagccgtgga

SEQ ID NO: 12255 - DNA, 20 bp, Artificial Sequence
  Description of Artificial Sequence: Synthetic oligonucleotide
  Target: ANGPTL3; (-) strand; PAM type: YTN; PAM sequence: TTA
tagttatgatcattgtaagc

SEQ ID NO: 12256 - DNA, 20 bp, Artificial Sequence
  Description of Artificial Sequence: Synthetic oligonucleotide
  Target: ANGPTL3; (-) strand; PAM type: YTN; PAM sequence: TTA
ataattatagttatgatcat

SEQ ID NO: 12257 - DNA, 20 bp, Artificial Sequence
  Description of Artificial Sequence: Synthetic oligonucleotide
  Target: ANGPTL3; (-) strand; PAM type: YTN; PAM sequence: TTT
aataattatagttatgatca

SEQ ID NO: 12258 - DNA, 20 bp, Artificial Sequence
  Description of Artificial Sequence: Synthetic oligonucleotide
  Target: ANGPTL3; (-) strand; PAM type: YTN; PAM sequence: CTT
taataattatagttatgatc

SEQ ID NO: 12259 - DNA, 20 bp, Artificial Sequence
  Description of Artificial Sequence: Synthetic oligonucleotide
  Target: ANGPTL3; (-) strand; PAM type: YTN; PAM sequence: TTG
tctttaataattatagttat

SEQ ID NO: 12260 - DNA, 20 bp, Artificial Sequence
  Description of Artificial Sequence: Synthetic oligonucleotide
  Target: ANGPTL3; (-) strand; PAM type: YTN; PAM sequence: TTA
atcaaaattgtctttaataa

SEQ ID NO: 12261 - DNA, 20 bp, Artificial Sequence
  Description of Artificial Sequence: Synthetic oligonucleotide
  Target: ANGPTL3; (-) strand; PAM type: YTN; PAM sequence: TTT
aatcaaaattgtctttaata

SEQ ID NO: 12262 - DNA, 20 bp, Artificial Sequence
  Description of Artificial Sequence: Synthetic oligonucleotide
  Target: ANGPTL3; (-) strand; PAM type: YTN; PAM sequence: TTA
tgacataacatttaatcaaa

SEQ ID NO: 12263 - DNA, 20 bp, Artificial Sequence
  Description of Artificial Sequence: Synthetic oligonucleotide
  Target: ANGPTL3; (-) strand; PAM type: YTN; PAM sequence: CTT
atgacataacatttaatcaa

SEQ ID NO: 12264 - DNA, 20 bp, Artificial Sequence
  Description of Artificial Sequence: Synthetic oligonucleotide
  Target: ANGPTL3; (-) strand; PAM type: YTN; PAM sequence: CTA
cttatgacataacatttaat

SEQ ID NO: 12265 - DNA, 20 bp, Artificial Sequence
  Description of Artificial Sequence: Synthetic oligonucleotide
  Target: ANGPTL3; (-) strand; PAM type: YTN; PAM sequence: TTA
ctacttatgacataacattt

SEQ ID NO: 12266 - DNA, 20 bp, Artificial Sequence
  Description of Artificial Sequence: Synthetic oligonucleotide
  Target: ANGPTL3; (-) strand; PAM type: YTN; PAM sequence: TTG
taacagttactacttatgac

SEQ ID NO: 12267 - DNA, 20 bp, Artificial Sequence
  Description of Artificial Sequence: Synthetic oligonucleotide
  Target: ANGPTL3; (-) strand; PAM type: YTN; PAM sequence: TTT
gtaacagttactacttatga

SEQ ID NO: 12268 - DNA, 20 bp, Artificial Sequence
  Description of Artificial Sequence: Synthetic oligonucleotide
  Target: ANGPTL3; (-) strand; PAM type: YTN; PAM sequence: TTA
tttgtaacagttactactta

SEQ ID NO: 12269 - DNA, 20 bp, Artificial Sequence
  Description of Artificial Sequence: Synthetic oligonucleotide
  Target: ANGPTL3; (-) strand; PAM type: YTN; PAM sequence: CTT
atttgtaacagttactactt

SEQ ID NO: 12270 - DNA, 20 bp, Artificial Sequence
  Description of Artificial Sequence: Synthetic oligonucleotide
  Target: ANGPTL3; (-) strand; PAM type: YTN; PAM sequence: TTC
acagcttatttgtaacagtt

SEQ ID NO: 12271 - DNA, 20 bp, Artificial Sequence
  Description of Artificial Sequence: Synthetic oligonucleotide
  Target: ANGPTL3; (-) strand; PAM type: YTN; PAM sequence: TTT
cacagcttatttgtaacagt

SEQ ID NO: 12272 - DNA, 20 bp, Artificial Sequence
  Description of Artificial Sequence: Synthetic oligonucleotide
  Target: ANGPTL3; (-) strand; PAM type: YTN; PAM sequence: TTT
tcacagcttatttgtaacag

SEQ ID NO: 12273 - DNA, 20 bp, Artificial Sequence
  Description of Artificial Sequence: Synthetic oligonucleotide
  Target: ANGPTL3; (-) strand; PAM type: YTN; PAM sequence: CTT
ttcacagcttatttgtaaca

SEQ ID NO: 12274 - DNA, 20 bp, Artificial Sequence
  Description of Artificial Sequence: Synthetic oligonucleotide
  Target: ANGPTL3; (-) strand; PAM type: YTN; PAM sequence: TTC
ttttcacagcttatttgtaa

SEQ ID NO: 12275 - DNA, 20 bp, Artificial Sequence
  Description of Artificial Sequence: Synthetic oligonucleotide
  Target: ANGPTL3; (-) strand; PAM type: YTN; PAM sequence: CTA
ggagtggttcttttcacagc

SEQ ID NO: 12276 - DNA, 20 bp, Artificial Sequence
  Description of Artificial Sequence: Synthetic oligonucleotide
  Target: ANGPTL3; (-) strand; PAM type: YTN; PAM sequence: CTA
atgctaggagtggttctttt

SEQ ID NO: 12277 - DNA, 20 bp, Artificial Sequence
  Description of Artificial Sequence: Synthetic oligonucleotide
  Target: ANGPTL3; (-) strand; PAM type: YTN; PAM sequence: TTA
atgagagaatagagtgacta

SEQ ID NO: 12278 - DNA, 20 bp, Artificial Sequence
  Description of Artificial Sequence: Synthetic oligonucleotide
  Target: ANGPTL3; (-) strand; PAM type: YTN; PAM sequence: TTG
atatgtaaaacgttaatgag

SEQ ID NO: 12279 - DNA, 20 bp, Artificial Sequence
  Description of Artificial Sequence: Synthetic oligonucleotide
  Target: ANGPTL3; (-) strand; PAM type: YTN; PAM sequence: TTA
attgatatgtaaaacgttaa

SEQ ID NO: 12280 - DNA, 20 bp, Artificial Sequence
  Description of Artificial Sequence: Synthetic oligonucleotide
  Target: ANGPTL3; (-) strand; PAM type: YTN; PAM sequence: TTC
caattaattgatatgtaaaa

SEQ ID NO: 12281 - DNA, 20 bp, Artificial Sequence
  Description of Artificial Sequence: Synthetic oligonucleotide
  Target: ANGPTL3; (-) strand; PAM type: YTN; PAM sequence: CTT
ccaattaattgatatgtaaa

SEQ ID NO: 12282 - DNA, 20 bp, Artificial Sequence
  Description of Artificial Sequence: Synthetic oligonucleotide
  Target: ANGPTL3; (-) strand; PAM type: YTN; PAM sequence: TTA
acttccaattaattgatatg

SEQ ID NO: 12283 - DNA, 20 bp, Artificial Sequence
  Description of Artificial Sequence: Synthetic oligonucleotide
  Target: ANGPTL3; (-) strand; PAM type: YTN; PAM sequence: TTT
aacttccaattaattgatat

SEQ ID NO: 12284 - DNA, 20 bp, Artificial Sequence
  Description of Artificial Sequence: Synthetic oligonucleotide
  Target: ANGPTL3; (-) strand; PAM type: YTN; PAM sequence: TTT
taacttccaattaattgata

SEQ ID NO: 12285 - DNA, 20 bp, Artificial Sequence
  Description of Artificial Sequence: Synthetic oligonucleotide
  Target: ANGPTL3; (-) strand; PAM type: YTN; PAM sequence: CTT
ttaacttccaattaattgat

SEQ ID NO: 12286 - DNA, 20 bp, Artificial Sequence
  Description of Artificial Sequence: Synthetic oligonucleotide
  Target: ANGPTL3; (-) strand; PAM type: YTN; PAM sequence: CTG
gtccttttaacttccaatta

SEQ ID NO: 12287 - DNA, 20 bp, Artificial Sequence
  Description of Artificial Sequence: Synthetic oligonucleotide
  Target: ANGPTL3; (-) strand; PAM type: YTN; PAM sequence: TTC
ctggtccttttaacttccaa

SEQ ID NO: 12288 - DNA, 20 bp, Artificial Sequence
  Description of Artificial Sequence: Synthetic oligonucleotide
  Target: ANGPTL3; (-) strand; PAM type: YTN; PAM sequence: TTT
cctggtccttttaacttcca

SEQ ID NO: 12289 - DNA, 20 bp, Artificial Sequence
  Description of Artificial Sequence: Synthetic oligonucleotide
  Target: ANGPTL3; (-) strand; PAM type: YTN; PAM sequence: CTG
agtttcctggtccttttaac

SEQ ID NO: 12290 - DNA, 20 bp, Artificial Sequence
  Description of Artificial Sequence: Synthetic oligonucleotide
  Target: ANGPTL3; (-) strand; PAM type: YTN; PAM sequence: CTG
tatgtctgagtttcctggtc

SEQ ID NO: 12291 - DNA, 20 bp, Artificial Sequence
  Description of Artificial Sequence: Synthetic oligonucleotide
  Target: ANGPTL3; (-) strand; PAM type: YTN; PAM sequence: TTA
aaatgtatactgtatgtctg

SEQ ID NO: 12292 - DNA, 20 bp, Artificial Sequence
  Description of Artificial Sequence: Synthetic oligonucleotide
  Target: ANGPTL3; (-) strand; PAM type: YTN; PAM sequence: TTT
aaaatgtatactgtatgtct

SEQ ID NO: 12293 - DNA, 20 bp, Artificial Sequence
  Description of Artificial Sequence: Synthetic oligonucleotide
  Target: ANGPTL3; (-) strand; PAM type: YTN; PAM sequence: TTT
taaaatgtatactgtatgtc

SEQ ID NO: 12294 - DNA, 20 bp, Artificial Sequence
  Description of Artificial Sequence: Synthetic oligonucleotide
  Target: ANGPTL3; (-) strand; PAM type: YTN; PAM sequence: TTG
aaattttaaaatgtatactg

SEQ ID NO: 12295 - DNA, 20 bp, Artificial Sequence
  Description of Artificial Sequence: Synthetic oligonucleotide
  Target: ANGPTL3; (-) strand; PAM type: YTN; PAM sequence: TTA
aataattgaaattttaaaat

SEQ ID NO: 12296 - DNA, 20 bp, Artificial Sequence
  Description of Artificial Sequence: Synthetic oligonucleotide
  Target: ANGPTL3; (-) strand; PAM type: YTN; PAM sequence: TTT
aaataattgaaattttaaaa

SEQ ID NO: 12297 - DNA, 20 bp, Artificial Sequence
  Description of Artificial Sequence: Synthetic oligonucleotide
  Target: ANGPTL3; (-) strand; PAM type: YTN; PAM sequence: TTA
tatttaaataattgaaattt

SEQ ID NO: 12298 - DNA, 20 bp, Artificial Sequence
  Description of Artificial Sequence: Synthetic oligonucleotide
  Target: ANGPTL3; (-) strand; PAM type: YTN; PAM sequence: CTA
tatattatatttaaataatt

SEQ ID NO: 12299 - DNA, 20 bp, Artificial Sequence
  Description of Artificial Sequence: Synthetic oligonucleotide
  Target: ANGPTL3; (-) strand; PAM type: YTN; PAM sequence: TTC
tatatattatatttaaataa

SEQ ID NO: 12300 - DNA, 20 bp, Artificial Sequence
  Description of Artificial Sequence: Synthetic oligonucleotide
  Target: ANGPTL3; (-) strand; PAM type: YTN; PAM sequence: TTA
taagccatacattctatata

SEQ ID NO: 12301 - DNA, 20 bp, Artificial Sequence
  Description of Artificial Sequence: Synthetic oligonucleotide
  Target: ANGPTL3; (-) strand; PAM type: YTN; PAM sequence: TTC
attataagccatacattcta

SEQ ID NO: 12302 - DNA, 20 bp, Artificial Sequence
  Description of Artificial Sequence: Synthetic oligonucleotide
  Target: ANGPTL3; (-) strand; PAM type: YTN; PAM sequence: CTA
attcattataagccatacat

SEQ ID NO: 12303 - DNA, 20 bp, Artificial Sequence
  Description of Artificial Sequence: Synthetic oligonucleotide
  Target: ANGPTL3; (-) strand; PAM type: YTN; PAM sequence: TTA
actaattcattataagccat

SEQ ID NO: 12304 - DNA, 20 bp, Artificial Sequence
  Description of Artificial Sequence: Synthetic oligonucleotide
  Target: ANGPTL3; (-) strand; PAM type: YTN; PAM sequence: TTG
agttaactaattcattataa

SEQ ID NO: 12305 - DNA, 20 bp, Artificial Sequence
  Description of Artificial Sequence: Synthetic oligonucleotide
  Target: ANGPTL3; (-) strand; PAM type: YTN; PAM sequence: TTG
cattgagttaactaattcat

SEQ ID NO: 12306 - DNA, 20 bp, Artificial Sequence
  Description of Artificial Sequence: Synthetic oligonucleotide
  Target: ANGPTL3; (-) strand; PAM type: YTN; PAM sequence: TTT
gcattgagttaactaattca

SEQ ID NO: 12307 - DNA, 20 bp, Artificial Sequence
  Description of Artificial Sequence: Synthetic oligonucleotide
  Target: ANGPTL3; (-) strand; PAM type: YTN; PAM sequence: TTG
taatcaaaatagaataattt

SEQ ID NO: 12308 - DNA, 20 bp, Artificial Sequence
  Description of Artificial Sequence: Synthetic oligonucleotide
  Target: ANGPTL3; (-) strand; PAM type: YTN; PAM sequence: TTT
gtaatcaaaatagaataatt

SEQ ID NO: 12309 - DNA, 20 bp, Artificial Sequence
  Description of Artificial Sequence: Synthetic oligonucleotide
  Target: ANGPTL3; (-) strand; PAM type: YTN; PAM sequence: CTA
tttgtaatcaaaatagaata

SEQ ID NO: 12310 - DNA, 20 bp, Artificial Sequence
  Description of Artificial Sequence: Synthetic oligonucleotide
  Target: ANGPTL3; (-) strand; PAM type: YTN; PAM sequence: TTA
ctatttgtaatcaaaataga

SEQ ID NO: 12311 - DNA, 20 bp, Artificial Sequence
  Description of Artificial Sequence: Synthetic oligonucleotide
  Target: ANGPTL3; (-) strand; PAM type: YTN; PAM sequence: TTT
actatttgtaatcaaaatag

SEQ ID NO: 12312 - DNA, 20 bp, Artificial Sequence
  Description of Artificial Sequence: Synthetic oligonucleotide
  Target: ANGPTL3; (-) strand; PAM type: YTN; PAM sequence: TTT
tactatttgtaatcaaaata

SEQ ID NO: 12313 - DNA, 20 bp, Artificial Sequence
  Description of Artificial Sequence: Synthetic oligonucleotide
  Target: ANGPTL3; (-) strand; PAM type: YTN; PAM sequence: TTA
ttttactatttgtaatcaaa

SEQ ID NO: 12314 - DNA, 20 bp, Artificial Sequence
  Description of Artificial Sequence: Synthetic oligonucleotide
  Target: ANGPTL3; (-) strand; PAM type: YTN; PAM sequence: CTT
attttactatttgtaatcaa

SEQ ID NO: 12315 - DNA, 20 bp, Artificial Sequence
  Description of Artificial Sequence: Synthetic oligonucleotide
  Target: ANGPTL3; (-) strand; PAM type: YTN; PAM sequence: TTG
cttattttactatttgtaat

SEQ ID NO: 12316 - DNA, 20 bp, Artificial Sequence
  Description of Artificial Sequence: Synthetic oligonucleotide
  Target: ANGPTL3; (-) strand; PAM type: YTN; PAM sequence: CTT
gcttattttactatttgtaa

SEQ ID NO: 12317 - DNA, 20 bp, Artificial Sequence
  Description of Artificial Sequence: Synthetic oligonucleotide
  Target: ANGPTL3; (-) strand; PAM type: YTN; PAM sequence: TTA
tcttgcttattttactattt

SEQ ID NO: 12318 - DNA, 20 bp, Artificial Sequence
  Description of Artificial Sequence: Synthetic oligonucleotide
  Target: ANGPTL3; (-) strand; PAM type: YTN; PAM sequence: TTT
atcttgcttattttactatt

SEQ ID NO: 12319 - DNA, 20 bp, Artificial Sequence
  Description of Artificial Sequence: Synthetic oligonucleotide
  Target: ANGPTL3; (-) strand; PAM type: YTN; PAM sequence: TTT
tatcttgcttattttactat

SEQ ID NO: 12320 - DNA, 20 bp, Artificial Sequence
  Description of Artificial Sequence: Synthetic oligonucleotide
  Target: ANGPTL3; (-) strand; PAM type: YTN; PAM sequence: TTA
ttttatcttgcttattttac

SEQ ID NO: 12321 - DNA, 20 bp, Artificial Sequence
  Description of Artificial Sequence: Synthetic oligonucleotide
  Target: ANGPTL3; (-) strand; PAM type: YTN; PAM sequence: CTG
ttattttatcttgcttattt

SEQ ID NO: 12322 - DNA, 20 bp, Artificial Sequence
  Description of Artificial Sequence: Synthetic oligonucleotide
  Target: ANGPTL3; (-) strand; PAM type: YTN; PAM sequence: TTA
aacatctgttattttatctt

SEQ ID NO: 12323 - DNA, 20 bp, Artificial Sequence
  Description of Artificial Sequence: Synthetic oligonucleotide
  Target: ANGPTL3; (-) strand; PAM type: YTN; PAM sequence: TTT
aaacatctgttattttatct

SEQ ID NO: 12324 - DNA, 20 bp, Artificial Sequence
  Description of Artificial Sequence: Synthetic oligonucleotide
  Target: ANGPTL3; (-) strand; PAM type: YTN; PAM sequence: TTT
taaacatctgttattttatc

SEQ ID NO: 12325 - DNA, 20 bp, Artificial Sequence
  Description of Artificial Sequence: Synthetic oligonucleotide
  Target: ANGPTL3; (-) strand; PAM type: YTN; PAM sequence: TTG
gattttaaacatctgttatt

SEQ ID NO: 12326 - DNA, 20 bp, Artificial Sequence
  Description of Artificial Sequence: Synthetic oligonucleotide
  Target: ANGPTL3; (-) strand; PAM type: YTN; PAM sequence: TTT
ggattttaaacatctgttat

SEQ ID NO: 12327 - DNA, 20 bp, Artificial Sequence
  Description of Artificial Sequence: Synthetic oligonucleotide
  Target: ANGPTL3; (-) strand; PAM type: YTN; PAM sequence: TTT
tggattttaaacatctgtta

SEQ ID NO: 12328 - DNA, 20 bp, Artificial Sequence
  Description of Artificial Sequence: Synthetic oligonucleotide
  Target: ANGPTL3; (-) strand; PAM type: YTN; PAM sequence: TTT
ttggattttaaacatctgtt

SEQ ID NO: 12329 - DNA, 20 bp, Artificial Sequence
  Description of Artificial Sequence: Synthetic oligonucleotide
  Target: ANGPTL3; (-) strand; PAM type: YTN; PAM sequence: CTT
tttggattttaaacatctgt

SEQ ID NO: 12330 - DNA, 20 bp, Artificial Sequence
  Description of Artificial Sequence: Synthetic oligonucleotide
  Target: ANGPTL3; (-) strand; PAM type: YTN; PAM sequence: TTG
tatgtgctttttggatttta

SEQ ID NO: 12331 - DNA, 20 bp, Artificial Sequence
  Description of Artificial Sequence: Synthetic oligonucleotide
  Target: ANGPTL3; (-) strand; PAM type: YTN; PAM sequence: TTT
gtatgtgctttttggatttt

SEQ ID NO: 12332 - DNA, 20 bp, Artificial Sequence
  Description of Artificial Sequence: Synthetic oligonucleotide
  Target: ANGPTL3; (-) strand; PAM type: YTN; PAM sequence: TTT
tgtatgtgctttttggattt

SEQ ID NO: 12333 - DNA, 20 bp, Artificial Sequence
  Description of Artificial Sequence: Synthetic oligonucleotide
  Target: ANGPTL3; (-) strand; PAM type: YTN; PAM sequence: TTT
ttgtatgtgctttttggatt

SEQ ID NO: 12334 - DNA, 20 bp, Artificial Sequence
  Description of Artificial Sequence: Synthetic oligonucleotide
  Target: ANGPTL3; (-) strand; PAM type: YTN; PAM sequence: TTC
atggatttttgtatgtgctt

SEQ ID NO: 12335 - DNA, 20 bp, Artificial Sequence
  Description of Artificial Sequence: Synthetic oligonucleotide
  Target: ANGPTL3; (-) strand; PAM type: YTN; PAM sequence: TTA
gacatcattcatggattttt

SEQ ID NO: 12336 - DNA, 20 bp, Artificial Sequence
  Description of Artificial Sequence: Synthetic oligonucleotide
  Target: ANGPTL3; (-) strand; PAM type: YTN; PAM sequence: CTT
agacatcattcatggatttt

SEQ ID NO: 12337 - DNA, 20 bp, Artificial Sequence
  Description of Artificial Sequence: Synthetic oligonucleotide
  Target: ANGPTL3; (-) strand; PAM type: YTN; PAM sequence: TTA
taagtgagtacttagacatc

SEQ ID NO: 12338 - DNA, 20 bp, Artificial Sequence
  Description of Artificial Sequence: Synthetic oligonucleotide
  Target: ANGPTL3; (-) strand; PAM type: YTN; PAM sequence: TTT
ataagtgagtacttagacat

SEQ ID NO: 12339 - DNA, 20 bp, Artificial Sequence
  Description of Artificial Sequence: Synthetic oligonucleotide
  Target: ANGPTL3; (-) strand; PAM type: YTN; PAM sequence: CTT
tataagtgagtacttagaca

SEQ ID NO: 12340 - DNA, 20 bp, Artificial Sequence
  Description of Artificial Sequence: Synthetic oligonucleotide
  Target: ANGPTL3; (-) strand; PAM type: YTN; PAM sequence: CTA
ctttataagtgagtacttag

SEQ ID NO: 12341 - DNA, 20 bp, Artificial Sequence
  Description of Artificial Sequence: Synthetic oligonucleotide
  Target: ANGPTL3; (-) strand; PAM type: YTN; PAM sequence: TTC
tactttataagtgagtactt

SEQ ID NO: 12342 - DNA, 20 bp, Artificial Sequence
  Description of Artificial Sequence: Synthetic oligonucleotide
  Target: ANGPTL3; (-) strand; PAM type: YTN; PAM sequence: CTT
ctactttataagtgagtact

SEQ ID NO: 12343 - DNA, 20 bp, Artificial Sequence
  Description of Artificial Sequence: Synthetic oligonucleotide
  Target: ANGPTL3; (-) strand; PAM type: YTN; PAM sequence: TTG
atataataatgaatgtcttc

SEQ ID NO: 12344 - DNA, 20 bp, Artificial Sequence
  Description of Artificial Sequence: Synthetic oligonucleotide
  Target: ANGPTL3; (-) strand; PAM type: YTN; PAM sequence: TTT
gatataataatgaatgtctt

SEQ ID NO: 12345 - DNA, 20 bp, Artificial Sequence
  Description of Artificial Sequence: Synthetic oligonucleotide
  Target: ANGPTL3; (-) strand; PAM type: YTN; PAM sequence: TTA
aaaatttgatataataatga

SEQ ID NO: 12346 - DNA, 20 bp, Artificial Sequence
  Description of Artificial Sequence: Synthetic oligonucleotide
  Target: ANGPTL3; (-) strand; PAM type: YTN; PAM sequence: TTT
aaaaatttgatataataatg

SEQ ID NO: 12347 - DNA, 20 bp, Artificial Sequence
  Description of Artificial Sequence: Synthetic oligonucleotide
  Target: ANGPTL3; (-) strand; PAM type: YTN; PAM sequence: CTG
agcatttaaaaatttgatat

SEQ ID NO: 12348 - DNA, 20 bp, Artificial Sequence
  Description of Artificial Sequence: Synthetic oligonucleotide
  Target: ANGPTL3; (-) strand; PAM type: YTN; PAM sequence: TTA
aatggtcaaatagtactgag

SEQ ID NO: 12349 - DNA, 20 bp, Artificial Sequence
  Description of Artificial Sequence: Synthetic oligonucleotide
  Target: ANGPTL3; (-) strand; PAM type: YTN; PAM sequence: TTT
aaatggtcaaatagtactga

SEQ ID NO: 12350 - DNA, 20 bp, Artificial Sequence
  Description of Artificial Sequence: Synthetic oligonucleotide
  Target: ANGPTL3; (-) strand; PAM type: YTN; PAM sequence: TTT
taaatggtcaaatagtactg

SEQ ID NO: 12351 - DNA, 20 bp, Artificial Sequence
  Description of Artificial Sequence: Synthetic oligonucleotide
  Target: ANGPTL3; (-) strand; PAM type: YTN; PAM sequence: TTT
ttaaatggtcaaatagtact

SEQ ID NO: 12352 - DNA, 20 bp, Artificial Sequence
  Description of Artificial Sequence: Synthetic oligonucleotide
  Target: ANGPTL3; (-) strand; PAM type: YTN; PAM sequence: TTG
aatacaaaatttttaaatgg

SEQ ID NO: 12353 - DNA, 20 bp, Artificial Sequence
  Description of Artificial Sequence: Synthetic oligonucleotide
  Target: ANGPTL3; (-) strand; PAM type: YTN; PAM sequence: TTT
gaatacaaaatttttaaatg

SEQ ID NO: 12354 - DNA, 20 bp, Artificial Sequence
  Description of Artificial Sequence: Synthetic oligonucleotide
  Target: ANGPTL3; (-) strand; PAM type: YTN; PAM sequence: CTG
gtagtttgaatacaaaattt

SEQ ID NO: 12355 - DNA, 20 bp, Artificial Sequence
  Description of Artificial Sequence: Synthetic oligonucleotide
  Target: ANGPTL3; (-) strand; PAM type: YTN; PAM sequence: TTC
actggtagtttgaatacaaa

SEQ ID NO: 12356 - DNA, 20 bp, Artificial Sequence
  Description of Artificial Sequence: Synthetic oligonucleotide
  Target: ANGPTL3; (-) strand; PAM type: YTN; PAM sequence: TTT
cactggtagtttgaatacaa

SEQ ID NO: 12357 - DNA, 20 bp, Artificial Sequence
  Description of Artificial Sequence: Synthetic oligonucleotide
  Target: ANGPTL3; (-) strand; PAM type: YTN; PAM sequence: CTT
tcactggtagtttgaataca

SEQ ID NO: 12358 - DNA, 20 bp, Artificial Sequence
  Description of Artificial Sequence: Synthetic oligonucleotide
  Target: ANGPTL3; (-) strand; PAM type: YTN; PAM sequence: CTA
ggtagggctttcactggtag

SEQ ID NO: 12359 - DNA, 20 bp, Artificial Sequence
  Description of Artificial Sequence: Synthetic oligonucleotide
  Target: ANGPTL3; (-) strand; PAM type: YTN; PAM sequence: TTC
taggtagggctttcactggt

SEQ ID NO: 12360 - DNA, 20 bp, Artificial Sequence
  Description of Artificial Sequence: Synthetic oligonucleotide
  Target: ANGPTL3; (-) strand; PAM type: YTN; PAM sequence: CTT
ctaggtagggctttcactgg

SEQ ID NO: 12361 - DNA, 20 bp, Artificial Sequence
  Description of Artificial Sequence: Synthetic oligonucleotide
  Target: ANGPTL3; (-) strand; PAM type: YTN; PAM sequence: CTG
agtataccttctaggtaggg

SEQ ID NO: 12362 - DNA, 20 bp, Artificial Sequence
  Description of Artificial Sequence: Synthetic oligonucleotide
  Target: ANGPTL3; (-) strand; PAM type: YTN; PAM sequence: TTA
tcactgagtataccttctag

SEQ ID NO: 12363 - DNA, 20 bp, Artificial Sequence
  Description of Artificial Sequence: Synthetic oligonucleotide
  Target: ANGPTL3; (-) strand; PAM type: YTN; PAM sequence: CTT
atcactgagtataccttcta

SEQ ID NO: 12364 - DNA, 20 bp, Artificial Sequence
  Description of Artificial Sequence: Synthetic oligonucleotide
  Target: ANGPTL3; (-) strand; PAM type: YTN; PAM sequence: CTA
caaaacttatcactgagtat

SEQ ID NO: 12365 - DNA, 20 bp, Artificial Sequence
  Description of Artificial Sequence: Synthetic oligonucleotide
  Target: ANGPTL3; (-) strand; PAM type: YTN; PAM sequence: TTG
gagctacaaaacttatcact

SEQ ID NO: 12366 - DNA, 20 bp, Artificial Sequence
  Description of Artificial Sequence: Synthetic oligonucleotide
  Target: ANGPTL3; (-) strand; PAM type: YTN; PAM sequence: TTT
ggagctacaaaacttatcac

SEQ ID NO: 12367 - DNA, 20 bp, Artificial Sequence
  Description of Artificial Sequence: Synthetic oligonucleotide
  Target: ANGPTL3; (-) strand; PAM type: YTN; PAM sequence: TTA
gaagatttggagctacaaaa

SEQ ID NO: 12368 - DNA, 20 bp, Artificial Sequence
  Description of Artificial Sequence: Synthetic oligonucleotide
  Target: ANGPTL3; (-) strand; PAM type: YTN; PAM sequence: CTA
ttagaagatttggagctaca

SEQ ID NO: 12369 - DNA, 20 bp, Artificial Sequence
  Description of Artificial Sequence: Synthetic oligonucleotide
  Target: ANGPTL3; (-) strand; PAM type: YTN; PAM sequence: CTC
actattagaagatttggagc

SEQ ID NO: 12370 - DNA, 20 bp, Artificial Sequence
  Description of Artificial Sequence: Synthetic oligonucleotide
  Target: ANGPTL3; (-) strand; PAM type: YTN; PAM sequence: TTA
cactcactattagaagattt

SEQ ID NO: 12371 - DNA, 20 bp, Artificial Sequence
  Description of Artificial Sequence: Synthetic oligonucleotide
  Target: ANGPTL3; (-) strand; PAM type: YTN; PAM sequence: TTG
gggttacactcactattaga

SEQ ID NO: 12372 - DNA, 20 bp, Artificial Sequence
  Description of Artificial Sequence: Synthetic oligonucleotide
  Target: ANGPTL3; (-) strand; PAM type: YTN; PAM sequence: TTT
ggggttacactcactattag

SEQ ID NO: 12373 - DNA, 20 bp, Artificial Sequence
  Description of Artificial Sequence: Synthetic oligonucleotide
  Target: ANGPTL3; (-) strand; PAM type: YTN; PAM sequence: TTT
tggggttacactcactatta

SEQ ID NO: 12374 - DNA, 20 bp, Artificial Sequence
  Description of Artificial Sequence: Synthetic oligonucleotide
  Target: ANGPTL3; (-) strand; PAM type: YTN; PAM sequence: TTA
ttttggggttacactcacta

SEQ ID NO: 12375 - DNA, 20 bp, Artificial Sequence
  Description of Artificial Sequence: Synthetic oligonucleotide
  Target: ANGPTL3; (-) strand; PAM type: YTN; PAM sequence: TTT
attttggggttacactcact

SEQ ID NO: 12376 - DNA, 20 bp, Artificial Sequence
  Description of Artificial Sequence: Synthetic oligonucleotide
  Target: ANGPTL3; (-) strand; PAM type: YTN; PAM sequence: TTT
tattttggggttacactcac

SEQ ID NO: 12377 - DNA, 20 bp, Artificial Sequence
  Description of Artificial Sequence: Synthetic oligonucleotide
  Target: ANGPTL3; (-) strand; PAM type: YTN; PAM sequence: CTT
ttattttggggttacactca

SEQ ID NO: 12378 - DNA, 20 bp, Artificial Sequence
  Description of Artificial Sequence: Synthetic oligonucleotide
  Target: ANGPTL3; (-) strand; PAM type: YTN; PAM sequence: CTG
tcagccttttattttggggt

SEQ ID NO: 12379 - DNA, 20 bp, Artificial Sequence
  Description of Artificial Sequence: Synthetic oligonucleotide
  Target: ANGPTL3; (-) strand; PAM type: YTN; PAM sequence: TTA
cctgtcagccttttattttg

SEQ ID NO: 12380 - DNA, 20 bp, Artificial Sequence
  Description of Artificial Sequence: Synthetic oligonucleotide
  Target: ANGPTL3; (-) strand; PAM type: YTN; PAM sequence: CTT
acctgtcagccttttatttt

SEQ ID NO: 12381 - DNA, 20 bp, Artificial Sequence
  Description of Artificial Sequence: Synthetic oligonucleotide
  Target: ANGPTL3; (-) strand; PAM type: YTN; PAM sequence: CTC
gacttacctgtcagcctttt

SEQ ID NO: 12382 - DNA, 20 bp, Artificial Sequence
  Description of Artificial Sequence: Synthetic oligonucleotide
  Target: ANGPTL3; (-) strand; PAM type: YTN; PAM sequence: TTC
tcgacttacctgtcagcctt

SEQ ID NO: 12383 - DNA, 20 bp, Artificial Sequence
  Description of Artificial Sequence: Synthetic oligonucleotide
  Target: ANGPTL3; (-) strand; PAM type: YTN; PAM sequence: TTA
agtgagtattctcgacttac

SEQ ID NO: 12384 - DNA, 20 bp, Artificial Sequence
  Description of Artificial Sequence: Synthetic oligonucleotide
  Target: ANGPTL3; (-) strand; PAM type: YTN; PAM sequence: TTA
ccagaattaagtgagtattc

SEQ ID NO: 12385 - DNA, 20 bp, Artificial Sequence
  Description of Artificial Sequence: Synthetic oligonucleotide
  Target: ANGPTL3; (-) strand; PAM type: YTN; PAM sequence: CTT
accagaattaagtgagtatt

SEQ ID NO: 12386 - DNA, 20 bp, Artificial Sequence
  Description of Artificial Sequence: Synthetic oligonucleotide
  Target: ANGPTL3; (-) strand; PAM type: YTN; PAM sequence: TTC
ttaccagaattaagtgagta

SEQ ID NO: 12387 - DNA, 20 bp, Artificial Sequence
  Description of Artificial Sequence: Synthetic oligonucleotide
  Target: ANGPTL3; (-) strand; PAM type: YTN; PAM sequence: TTT
cttaccagaattaagtgagt

SEQ ID NO: 12388 - DNA, 20 bp, Artificial Sequence
  Description of Artificial Sequence: Synthetic oligonucleotide
  Target: ANGPTL3; (-) strand; PAM type: YTN; PAM sequence: CTT
tcttaccagaattaagtgag

SEQ ID NO: 12389 - DNA, 20 bp, Artificial Sequence
  Description of Artificial Sequence: Synthetic oligonucleotide
  Target: ANGPTL3; (-) strand; PAM type: YTN; PAM sequence: TTG
ctttcttaccagaattaagt

SEQ ID NO: 12390 - DNA, 20 bp, Artificial Sequence
  Description of Artificial Sequence: Synthetic oligonucleotide
  Target: ANGPTL3; (-) strand; PAM type: YTN; PAM sequence: CTG
gtaaatacaagtacaaatgg

SEQ ID NO: 12391 - DNA, 20 bp, Artificial Sequence
  Description of Artificial Sequence: Synthetic oligonucleotide
  Target: ANGPTL3; (-) strand; PAM type: YTN; PAM sequence: TTG
ctggtaaatacaagtacaaa

SEQ ID NO: 12392 - DNA, 20 bp, Artificial Sequence
  Description of Artificial Sequence: Synthetic oligonucleotide
  Target: ANGPTL3; (-) strand; PAM type: YTN; PAM sequence: TTA
aggattgctggtaaatacaa

SEQ ID NO: 12393 - DNA, 20 bp, Artificial Sequence
  Description of Artificial Sequence: Synthetic oligonucleotide
  Target: ANGPTL3; (-) strand; PAM type: YTN; PAM sequence: TTT
aaggattgctggtaaataca

SEQ ID NO: 12394 - DNA, 20 bp, Artificial Sequence
  Description of Artificial Sequence: Synthetic oligonucleotide
  Target: ANGPTL3; (-) strand; PAM type: YTN; PAM sequence: TTT
taaggattgctggtaaatac

SEQ ID NO: 12395 - DNA, 20 bp, Artificial Sequence
  Description of Artificial Sequence: Synthetic oligonucleotide
  Target: ANGPTL3; (-) strand; PAM type: YTN; PAM sequence: TTC
attttaaggattgctggtaa

SEQ ID NO: 12396 - DNA, 20 bp, Artificial Sequence
  Description of Artificial Sequence: Synthetic oligonucleotide
  Target: ANGPTL3; (-) strand; PAM type: YTN; PAM sequence: CTT
cattttaaggattgctggta

SEQ ID NO: 12397 - DNA, 20 bp, Artificial Sequence
  Description of Artificial Sequence: Synthetic oligonucleotide
  Target: ANGPTL3; (-) strand; PAM type: YTN; PAM sequence: TTA
gtaggaagcttcattttaag

SEQ ID NO: 12398 - DNA, 20 bp, Artificial Sequence
  Description of Artificial Sequence: Synthetic oligonucleotide
  Target: ANGPTL3; (-) strand; PAM type: YTN; PAM sequence: TTG
agttagtaggaagcttcatt

SEQ ID NO: 12399 - DNA, 20 bp, Artificial Sequence
  Description of Artificial Sequence: Synthetic oligonucleotide
  Target: ANGPTL3; (-) strand; PAM type: YTN; PAM sequence: CTA
ttgagttagtaggaagcttc

SEQ ID NO: 12400 - DNA, 20 bp, Artificial Sequence
  Description of Artificial Sequence: Synthetic oligonucleotide
  Target: ANGPTL3; (-) strand; PAM type: YTN; PAM sequence: TTG
ctattgagttagtaggaagc

SEQ ID NO: 12401 - DNA, 20 bp, Artificial Sequence
  Description of Artificial Sequence: Synthetic oligonucleotide
  Target: ANGPTL3; (-) strand; PAM type: YTN; PAM sequence: TTA
ttgctattgagttagtagga

SEQ ID NO: 12402 - DNA, 20 bp, Artificial Sequence
  Description of Artificial Sequence: Synthetic oligonucleotide
  Target: ANGPTL3; (-) strand; PAM type: YTN; PAM sequence: CTT
attgctattgagttagtagg

SEQ ID NO: 12403 - DNA, 20 bp, Artificial Sequence
  Description of Artificial Sequence: Synthetic oligonucleotide
  Target: ANGPTL3; (-) strand; PAM type: YTN; PAM sequence: TTG
tcttattgctattgagttag

SEQ ID NO: 12404 - DNA, 20 bp, Artificial Sequence
  Description of Artificial Sequence: Synthetic oligonucleotide
  Target: ANGPTL3; (-) strand; PAM type: YTN; PAM sequence: CTA
ttgtcttattgctattgagt

SEQ ID NO: 12405 - DNA, 20 bp, Artificial Sequence
  Description of Artificial Sequence: Synthetic oligonucleotide
  Target: ANGPTL3; (-) strand; PAM type: YTN; PAM sequence: TTC
actattgtcttattgctatt

SEQ ID NO: 12406 - DNA, 20 bp, Artificial Sequence
  Description of Artificial Sequence: Synthetic oligonucleotide
  Target: ANGPTL3; (-) strand; PAM type: YTN; PAM sequence: TTA
aacattcactattgtcttat

SEQ ID NO: 12407 - DNA, 20 bp, Artificial Sequence
  Description of Artificial Sequence: Synthetic oligonucleotide
  Target: ANGPTL3; (-) strand; PAM type: YTN; PAM sequence: TTC
attaaacattcactattgtc

SEQ ID NO: 12408 - DNA, 20 bp, Artificial Sequence
  Description of Artificial Sequence: Synthetic oligonucleotide
  Target: ANGPTL3; (-) strand; PAM type: YTN; PAM sequence: TTT
cattaaacattcactattgt

SEQ ID NO: 12409 - DNA, 20 bp, Artificial Sequence
  Description of Artificial Sequence: Synthetic oligonucleotide
  Target: ANGPTL3; (-) strand; PAM type: YTN; PAM sequence: TTT
tcattaaacattcactattg

SEQ ID NO: 12410 - DNA, 20 bp, Artificial Sequence
  Description of Artificial Sequence: Synthetic oligonucleotide
  Target: ANGPTL3; (-) strand; PAM type: YTN; PAM sequence: CTG
ttttcattaaacattcacta

SEQ ID NO: 12411 - DNA, 20 bp, Artificial Sequence
  Description of Artificial Sequence: Synthetic oligonucleotide
  Target: ANGPTL3; (-) strand; PAM type: YTN; PAM sequence: TTA
taaaatactgttttcattaa

SEQ ID NO: 12412 - DNA, 20 bp, Artificial Sequence
  Description of Artificial Sequence: Synthetic oligonucleotide
  Target: ANGPTL3; (-) strand; PAM type: YTN; PAM sequence: TTT
ataaaatactgttttcatta

SEQ ID NO: 12413 - DNA, 20 bp, Artificial Sequence
  Description of Artificial Sequence: Synthetic oligonucleotide
  Target: ANGPTL3; (-) strand; PAM type: YTN; PAM sequence: TTA
aagtatttataaaatactgt

SEQ ID NO: 12414 - DNA, 20 bp, Artificial Sequence
  Description of Artificial Sequence: Synthetic oligonucleotide
  Target: ANGPTL3; (-) strand; PAM type: YTN; PAM sequence: TTA
ttaaagtatttataaaatac

SEQ ID NO: 12415 - DNA, 20 bp, Artificial Sequence
  Description of Artificial Sequence: Synthetic oligonucleotide
  Target: ANGPTL3; (-) strand; PAM type: YTN; PAM sequence: TTT
attaaagtatttataaaata

SEQ ID NO: 12416 - DNA, 20 bp, Artificial Sequence
  Description of Artificial Sequence: Synthetic oligonucleotide
  Target: ANGPTL3; (-) strand; PAM type: YTN; PAM sequence: TTT
tattaaagtatttataaaat

SEQ ID NO: 12417 - DNA, 20 bp, Artificial Sequence
  Description of Artificial Sequence: Synthetic oligonucleotide
  Target: ANGPTL3; (-) strand; PAM type: YTN; PAM sequence: TTT
ttattaaagtatttataaaa

SEQ ID NO: 12418 - DNA, 20 bp, Artificial Sequence
  Description of Artificial Sequence: Synthetic oligonucleotide
  Target: ANGPTL3; (-) strand; PAM type: YTN; PAM sequence: CTT
tttattaaagtatttataaa

SEQ ID NO: 12419 - DNA, 20 bp, Artificial Sequence
  Description of Artificial Sequence: Synthetic oligonucleotide
  Target: ANGPTL3; (-) strand; PAM type: YTN; PAM sequence: TTC
atcacaatcctttttattaa

SEQ ID NO: 12420 - DNA, 20 bp, Artificial Sequence
  Description of Artificial Sequence: Synthetic oligonucleotide
  Target: ANGPTL3; (-) strand; PAM type: YTN; PAM sequence: CTT
catcacaatcctttttatta

SEQ ID NO: 12421 - DNA, 20 bp, Artificial Sequence
  Description of Artificial Sequence: Synthetic oligonucleotide
  Target: ANGPTL3; (-) strand; PAM type: YTN; PAM sequence: TTC
ttcatcacaatcctttttat

SEQ ID NO: 12422 - DNA, 20 bp, Artificial Sequence
  Description of Artificial Sequence: Synthetic oligonucleotide
  Target: ANGPTL3; (-) strand; PAM type: YTN; PAM sequence: TTG
ttcttcatcacaatcctttt

SEQ ID NO: 12423 - DNA, 20 bp, Artificial Sequence
  Description of Artificial Sequence: Synthetic oligonucleotide
  Target: ANGPTL3; (-) strand; PAM type: YTN; PAM sequence: TTA
aaaacaaataacaaatataa

SEQ ID NO: 12424 - DNA, 20 bp, Artificial Sequence
  Description of Artificial Sequence: Synthetic oligonucleotide
  Target: ANGPTL3; (-) strand; PAM type: YTN; PAM sequence: TTG
gaattaaaaacaaataacaa

SEQ ID NO: 12425 - DNA, 20 bp, Artificial Sequence
  Description of Artificial Sequence: Synthetic oligonucleotide
  Target: ANGPTL3; (-) strand; PAM type: YTN; PAM sequence: TTA
ttggaattaaaaacaaataa

SEQ ID NO: 12426 - DNA, 20 bp, Artificial Sequence
  Description of Artificial Sequence: Synthetic oligonucleotide
  Target: ANGPTL3; (-) strand; PAM type: YTN; PAM sequence: TTT
attggaattaaaaacaaata

SEQ ID NO: 12427 - DNA, 20 bp, Artificial Sequence
  Description of Artificial Sequence: Synthetic oligonucleotide
  Target: ANGPTL3; (-) strand; PAM type: YTN; PAM sequence: TTT
tattggaattaaaaacaaat

SEQ ID NO: 12428 - DNA, 20 bp, Artificial Sequence
  Description of Artificial Sequence: Synthetic oligonucleotide
  Target: ANGPTL3; (-) strand; PAM type: YTN; PAM sequence: TTT
ttattggaattaaaaacaaa

SEQ ID NO: 12429 - DNA, 20 bp, Artificial Sequence
  Description of Artificial Sequence: Synthetic oligonucleotide
  Target: ANGPTL3; (-) strand; PAM type: YTN; PAM sequence: TTA
tttttattggaattaaaaac

SEQ ID NO: 12430 - DNA, 20 bp, Artificial Sequence
  Description of Artificial Sequence: Synthetic oligonucleotide
  Target: ANGPTL3; (-) strand; PAM type: YTN; PAM sequence: TTA
aaaattatttttattggaat

SEQ ID NO: 12431 - DNA, 20 bp, Artificial Sequence
  Description of Artificial Sequence: Synthetic oligonucleotide
  Target: ANGPTL3; (-) strand; PAM type: YTN; PAM sequence: TTT
aaaaattatttttattggaa

SEQ ID NO: 12432 - DNA, 20 bp, Artificial Sequence
  Description of Artificial Sequence: Synthetic oligonucleotide
  Target: ANGPTL3; (-) strand; PAM type: YTN; PAM sequence: TTT
taaaaattatttttattgga

SEQ ID NO: 12433 - DNA, 20 bp, Artificial Sequence
  Description of Artificial Sequence: Synthetic oligonucleotide
  Target: ANGPTL3; (-) strand; PAM type: YTN; PAM sequence: CTG
taattttaaaaattattttt

SEQ ID NO: 12434 - DNA, 20 bp, Artificial Sequence
  Description of Artificial Sequence: Synthetic oligonucleotide
  Target: ANGPTL3; (-) strand; PAM type: YTN; PAM sequence: TTC
tgtaattttaaaaattattt

SEQ ID NO: 12435 - DNA, 20 bp, Artificial Sequence
  Description of Artificial Sequence: Synthetic oligonucleotide
  Target: ANGPTL3; (-) strand; PAM type: YTN; PAM sequence: TTT
ctgtaattttaaaaattatt

SEQ ID NO: 12436 - DNA, 20 bp, Artificial Sequence
  Description of Artificial Sequence: Synthetic oligonucleotide
  Target: ANGPTL3; (-) strand; PAM type: YTN; PAM sequence: TTT
tctgtaattttaaaaattat

SEQ ID NO: 12437 - DNA, 20 bp, Artificial Sequence
  Description of Artificial Sequence: Synthetic oligonucleotide
  Target: ANGPTL3; (-) strand; PAM type: YTN; PAM sequence: TTT
ttctgtaattttaaaaatta

SEQ ID NO: 12438 - DNA, 20 bp, Artificial Sequence
  Description of Artificial Sequence: Synthetic oligonucleotide
  Target: ANGPTL3; (-) strand; PAM type: YTN; PAM sequence: TTT
tttctgtaattttaaaaatt

SEQ ID NO: 12439 - DNA, 20 bp, Artificial Sequence
  Description of Artificial Sequence: Synthetic oligonucleotide
  Target: ANGPTL3; (-) strand; PAM type: YTN; PAM sequence: CTT
ttttctgtaattttaaaaat

SEQ ID NO: 12440 - DNA, 20 bp, Artificial Sequence
  Description of Artificial Sequence: Synthetic oligonucleotide
  Target: ANGPTL3; (-) strand; PAM type: YTN; PAM sequence: TTA
ataacttttttctgtaattt

SEQ ID NO: 12441 - DNA, 20 bp, Artificial Sequence
  Description of Artificial Sequence: Synthetic oligonucleotide
  Target: ANGPTL3; (-) strand; PAM type: YTN; PAM sequence: CTT
aataacttttttctgtaatt

SEQ ID NO: 12442 - DNA, 20 bp, Artificial Sequence
  Description of Artificial Sequence: Synthetic oligonucleotide
  Target: ANGPTL3; (-) strand; PAM type: YTN; PAM sequence: TTC
ttaataacttttttctgtaa

SEQ ID NO: 12443 - DNA, 20 bp, Artificial Sequence
  Description of Artificial Sequence: Synthetic oligonucleotide
  Target: ANGPTL3; (-) strand; PAM type: YTN; PAM sequence: TTA
aaagcatggttcttaataac

SEQ ID NO: 12444 - DNA, 20 bp, Artificial Sequence
  Description of Artificial Sequence: Synthetic oligonucleotide
  Target: ANGPTL3; (-) strand; PAM type: YTN; PAM sequence: TTT
aaaagcatggttcttaataa

SEQ ID NO: 12445 - DNA, 20 bp, Artificial Sequence
  Description of Artificial Sequence: Synthetic oligonucleotide
  Target: ANGPTL3; (-) strand; PAM type: YTN; PAM sequence: TTA
aatttaaaagcatggttctt

SEQ ID NO: 12446 - DNA, 20 bp, Artificial Sequence
  Description of Artificial Sequence: Synthetic oligonucleotide
  Target: ANGPTL3; (-) strand; PAM type: YTN; PAM sequence: TTT
aaatttaaaagcatggttct

SEQ ID NO: 12447 - DNA, 20 bp, Artificial Sequence
  Description of Artificial Sequence: Synthetic oligonucleotide
  Target: ANGPTL3; (-) strand; PAM type: YTN; PAM sequence: TTT
taaatttaaaagcatggttc

SEQ ID NO: 12448 - DNA, 20 bp, Artificial Sequence
  Description of Artificial Sequence: Synthetic oligonucleotide
  Target: ANGPTL3; (-) strand; PAM type: YTN; PAM sequence: TTA
aaaaatcattttaaatttaa

SEQ ID NO: 12449 - DNA, 20 bp, Artificial Sequence
  Description of Artificial Sequence: Synthetic oligonucleotide
  Target: ANGPTL3; (-) strand; PAM type: YTN; PAM sequence: TTT
aaaaaatcattttaaattta

SEQ ID NO: 12450 - DNA, 20 bp, Artificial Sequence
  Description of Artificial Sequence: Synthetic oligonucleotide
  Target: ANGPTL3; (-) strand; PAM type: YTN; PAM sequence: TTG
tagaaaaagacaggaataaa

SEQ ID NO: 12451 - DNA, 20 bp, Artificial Sequence
  Description of Artificial Sequence: Synthetic oligonucleotide
  Target: ANGPTL3; (-) strand; PAM type: YTN; PAM sequence: TTT
gtagaaaaagacaggaataa

SEQ ID NO: 12452 - DNA, 20 bp, Artificial Sequence
  Description of Artificial Sequence: Synthetic oligonucleotide
  Target: ANGPTL3; (-) strand; PAM type: YTN; PAM sequence: CTT
tgtagaaaaagacaggaata

SEQ ID NO: 12453 - DNA, 20 bp, Artificial Sequence
  Description of Artificial Sequence: Synthetic oligonucleotide
  Target: ANGPTL3; (-) strand; PAM type: YTN; PAM sequence: TTC
tttgtagaaaaagacaggaa

SEQ ID NO: 12454 - DNA, 20 bp, Artificial Sequence
  Description of Artificial Sequence: Synthetic oligonucleotide
  Target: ANGPTL3; (-) strand; PAM type: YTN; PAM sequence: TTT
ctttgtagaaaaagacagga

SEQ ID NO: 12455 - DNA, 20 bp, Artificial Sequence
  Description of Artificial Sequence: Synthetic oligonucleotide
  Target: ANGPTL3; (-) strand; PAM type: YTN; PAM sequence: CTT
tctttgtagaaaaagacagg

SEQ ID NO: 12456 - DNA, 20 bp, Artificial Sequence
  Description of Artificial Sequence: Synthetic oligonucleotide
  Target: ANGPTL3; (-) strand; PAM type: YTN; PAM sequence: TTA
atgtatgctttctttgtaga

SEQ ID NO: 12457 - DNA, 20 bp, Artificial Sequence
  Description of Artificial Sequence: Synthetic oligonucleotide
  Target: ANGPTL3; (-) strand; PAM type: YTN; PAM sequence: CTT
aatgtatgctttctttgtag

SEQ ID NO: 12458 - DNA, 20 bp, Artificial Sequence
  Description of Artificial Sequence: Synthetic oligonucleotide
  Target: ANGPTL3; (-) strand; PAM type: YTN; PAM sequence: TTG
cttaatgtatgctttctttg

SEQ ID NO: 12459 - DNA, 20 bp, Artificial Sequence
  Description of Artificial Sequence: Synthetic oligonucleotide
  Target: ANGPTL3; (-) strand; PAM type: YTN; PAM sequence: TTT
gcttaatgtatgctttcttt

SEQ ID NO: 12460 - DNA, 20 bp, Artificial Sequence
  Description of Artificial Sequence: Synthetic oligonucleotide
  Target: ANGPTL3; (-) strand; PAM type: YTN; PAM sequence: TTG
gtatttgcttaatgtatgct

SEQ ID NO: 12461 - DNA, 20 bp, Artificial Sequence
  Description of Artificial Sequence: Synthetic oligonucleotide
  Target: ANGPTL3; (-) strand; PAM type: YTN; PAM sequence: TTT
ggtatttgcttaatgtatgc

SEQ ID NO: 12462 - DNA, 20 bp, Artificial Sequence
  Description of Artificial Sequence: Synthetic oligonucleotide
  Target: ANGPTL3; (-) strand; PAM type: YTN; PAM sequence: CTT
tggtatttgcttaatgtatg

SEQ ID NO: 12463 - DNA, 20 bp, Artificial Sequence
  Description of Artificial Sequence: Synthetic oligonucleotide
  Target: ANGPTL3; (-) strand; PAM type: YTN; PAM sequence: CTG
gcctttggtatttgcttaat

SEQ ID NO: 12464 - DNA, 20 bp, Artificial Sequence
  Description of Artificial Sequence: Synthetic oligonucleotide
  Target: ANGPTL3; (-) strand; PAM type: YTN; PAM sequence: TTC
aaatgtaaacctggcctttg

SEQ ID NO: 12465 - DNA, 20 bp, Artificial Sequence
  Description of Artificial Sequence: Synthetic oligonucleotide
  Target: ANGPTL3; (-) strand; PAM type: YTN; PAM sequence: CTT
caaatgtaaacctggccttt

SEQ ID NO: 12466 - DNA, 20 bp, Artificial Sequence
  Description of Artificial Sequence: Synthetic oligonucleotide
  Target: ANGPTL3; (-) strand; PAM type: YTN; PAM sequence: TTC
ttcaaatgtaaacctggcct

SEQ ID NO: 12467 - DNA, 20 bp, Artificial Sequence
  Description of Artificial Sequence: Synthetic oligonucleotide
  Target: ANGPTL3; (-) strand; PAM type: YTN; PAM sequence: TTT
cttcaaatgtaaacctggcc

SEQ ID NO: 12468 - DNA, 20 bp, Artificial Sequence
  Description of Artificial Sequence: Synthetic oligonucleotide
  Target: ANGPTL3; (-) strand; PAM type: YTN; PAM sequence: CTT
tcttcaaatgtaaacctggc

SEQ ID NO: 12469 - DNA, 20 bp, Artificial Sequence
  Description of Artificial Sequence: Synthetic oligonucleotide
  Target: ANGPTL3; (-) strand; PAM type: YTN; PAM sequence: TTG
agtaataataatgtcacttt

SEQ ID NO: 12470 - DNA, 20 bp, Artificial Sequence
  Description of Artificial Sequence: Synthetic oligonucleotide
  Target: ANGPTL3; (-) strand; PAM type: YTN; PAM sequence: CTT
gagtaataataatgtcactt

SEQ ID NO: 12471 - DNA, 20 bp, Artificial Sequence
  Description of Artificial Sequence: Synthetic oligonucleotide
  Target: ANGPTL3; (-) strand; PAM type: YTN; PAM sequence: CTA
gagacttgagtaataataat

SEQ ID NO: 12472 - DNA, 20 bp, Artificial Sequence
  Description of Artificial Sequence: Synthetic oligonucleotide
  Target: ANGPTL3; (-) strand; PAM type: YTN; PAM sequence: TTC
ctagagacttgagtaataat

SEQ ID NO: 12473 - DNA, 20 bp, Artificial Sequence
  Description of Artificial Sequence: Synthetic oligonucleotide
  Target: ANGPTL3; (-) strand; PAM type: YTN; PAM sequence: TTA
agtattcctagagacttgag

SEQ ID NO: 12474 - DNA, 20 bp, Artificial Sequence
  Description of Artificial Sequence: Synthetic oligonucleotide
  Target: ANGPTL3; (-) strand; PAM type: YTN; PAM sequence: TTA
acatccatatacagtcaaga

SEQ ID NO: 12475 - DNA, 20 bp, Artificial Sequence
  Description of Artificial Sequence: Synthetic oligonucleotide
  Target: ANGPTL3; (-) strand; PAM type: YTN; PAM sequence: TTA
ttaacatccatatacagtca

SEQ ID NO: 12476 - DNA, 20 bp, Artificial Sequence
  Description of Artificial Sequence: Synthetic oligonucleotide
  Target: ANGPTL3; (-) strand; PAM type: YTN; PAM sequence: TTT
attaacatccatatacagtc

SEQ ID NO: 12477 - DNA, 20 bp, Artificial Sequence
  Description of Artificial Sequence: Synthetic oligonucleotide
  Target: ANGPTL3; (-) strand; PAM type: YTN; PAM sequence: CTA
tttattaacatccatataca

SEQ ID NO: 12478 - DNA, 20 bp, Artificial Sequence
  Description of Artificial Sequence: Synthetic oligonucleotide
  Target: ANGPTL3; (-) strand; PAM type: YTN; PAM sequence: CTG
tcagctatttattaacatcc

SEQ ID NO: 12479 - DNA, 20 bp, Artificial Sequence
  Description of Artificial Sequence: Synthetic oligonucleotide
  Target: ANGPTL3; (-) strand; PAM type: YTN; PAM sequence: TTA
ctgtcagctatttattaaca

SEQ ID NO: 12480 - DNA, 20 bp, Artificial Sequence
  Description of Artificial Sequence: Synthetic oligonucleotide
  Target: ANGPTL3; (-) strand; PAM type: YTN; PAM sequence: TTT
actgtcagctatttattaac

SEQ ID NO: 12481 - DNA, 20 bp, Artificial Sequence
  Description of Artificial Sequence: Synthetic oligonucleotide
  Target: ANGPTL3; (-) strand; PAM type: YTN; PAM sequence: CTT
tactgtcagctatttattaa

SEQ ID NO: 12482 - DNA, 20 bp, Artificial Sequence
  Description of Artificial Sequence: Synthetic oligonucleotide
  Target: ANGPTL3; (-) strand; PAM type: YTN; PAM sequence: TTA
tatggataaactttactgtc

SEQ ID NO: 12483 - DNA, 20 bp, Artificial Sequence
  Description of Artificial Sequence: Synthetic oligonucleotide
  Target: ANGPTL3; (-) strand; PAM type: YTN; PAM sequence: TTT
atatggataaactttactgt

SEQ ID NO: 12484 - DNA, 20 bp, Artificial Sequence
  Description of Artificial Sequence: Synthetic oligonucleotide
  Target: ANGPTL3; (-) strand; PAM type: YTN; PAM sequence: CTT
tatatggataaactttactg

SEQ ID NO: 12485 - DNA, 20 bp, Artificial Sequence
  Description of Artificial Sequence: Synthetic oligonucleotide
  Target: ANGPTL3; (-) strand; PAM type: YTN; PAM sequence: TTG
caagtctttatatggataaa

SEQ ID NO: 12486 - DNA, 20 bp, Artificial Sequence
  Description of Artificial Sequence: Synthetic oligonucleotide
  Target: ANGPTL3; (-) strand; PAM type: YTN; PAM sequence: TTT
gcaagtctttatatggataa

SEQ ID NO: 12487 - DNA, 20 bp, Artificial Sequence
  Description of Artificial Sequence: Synthetic oligonucleotide
  Target: ANGPTL3; (-) strand; PAM type: YTN; PAM sequence: TTG
gtagaggaatatttgcaagt

SEQ ID NO: 12488 - DNA, 20 bp, Artificial Sequence
  Description of Artificial Sequence: Synthetic oligonucleotide
  Target: ANGPTL3; (-) strand; PAM type: YTN; PAM sequence: CTC
gtcattggtagaggaatatt

SEQ ID NO: 12489 - DNA, 20 bp, Artificial Sequence
  Description of Artificial Sequence: Synthetic oligonucleotide
  Target: ANGPTL3; (-) strand; PAM type: YTN; PAM sequence: TTA
aagtctcgtcattggtagag

SEQ ID NO: 12490 - DNA, 20 bp, Artificial Sequence
  Description of Artificial Sequence: Synthetic oligonucleotide
  Target: ANGPTL3; (-) strand; PAM type: YTN; PAM sequence: TTT
aaagtctcgtcattggtaga

SEQ ID NO: 12491 - DNA, 20 bp, Artificial Sequence
  Description of Artificial Sequence: Synthetic oligonucleotide
  Target: ANGPTL3; (-) strand; PAM type: YTN; PAM sequence: TTT
taaagtctcgtcattggtag

SEQ ID NO: 12492 - DNA, 20 bp, Artificial Sequence
  Description of Artificial Sequence: Synthetic oligonucleotide
  Target: ANGPTL3; (-) strand; PAM type: YTN; PAM sequence: TTA
tagatattttaaagtctcgt

SEQ ID NO: 12493 - DNA, 20 bp, Artificial Sequence
  Description of Artificial Sequence: Synthetic oligonucleotide
  Target: ANGPTL3; (-) strand; PAM type: YTN; PAM sequence: TTA
ttatagatattttaaagtct

SEQ ID NO: 12494 - DNA, 20 bp, Artificial Sequence
  Description of Artificial Sequence: Synthetic oligonucleotide
  Target: ANGPTL3; (-) strand; PAM type: YTN; PAM sequence: TTA
cattattatagatattttaa

SEQ ID NO: 12495 - DNA, 20 bp, Artificial Sequence
  Description of Artificial Sequence: Synthetic oligonucleotide
  Target: ANGPTL3; (-) strand; PAM type: YTN; PAM sequence: TTC
accagtgaaatgtgttacat

SEQ ID NO: 12496 - DNA, 20 bp, Artificial Sequence
  Description of Artificial Sequence: Synthetic oligonucleotide
  Target: ANGPTL3; (-) strand; PAM type: YTN; PAM sequence: TTT
caccagtgaaatgtgttaca

SEQ ID NO: 12497 - DNA, 20 bp, Artificial Sequence
  Description of Artificial Sequence: Synthetic oligonucleotide
  Target: ANGPTL3; (-) strand; PAM type: YTN; PAM sequence: CTA
taatgcatatgacaagacat

SEQ ID NO: 12498 - DNA, 20 bp, Artificial Sequence
  Description of Artificial Sequence: Synthetic oligonucleotide
  Target: ANGPTL3; (-) strand; PAM type: YTN; PAM sequence: TTC
tataatgcatatgacaagac

SEQ ID NO: 12499 - DNA, 20 bp, Artificial Sequence
  Description of Artificial Sequence: Synthetic oligonucleotide
  Target: ANGPTL3; (-) strand; PAM type: YTN; PAM sequence: TTT
ctataatgcatatgacaaga

SEQ ID NO: 12500 - DNA, 20 bp, Artificial Sequence
  Description of Artificial Sequence: Synthetic oligonucleotide
  Target: ANGPTL3; (-) strand; PAM type: YTN; PAM sequence: CTT
tctataatgcatatgacaag

SEQ ID NO: 12501 - DNA, 20 bp, Artificial Sequence
  Description of Artificial Sequence: Synthetic oligonucleotide
  Target: ANGPTL3; (-) strand; PAM type: YTN; PAM sequence: TTA
tcctttctataatgcatatg

SEQ ID NO: 12502 - DNA, 20 bp, Artificial Sequence
  Description of Artificial Sequence: Synthetic oligonucleotide
  Target: ANGPTL3; (-) strand; PAM type: YTN; PAM sequence: CTG
attatcctttctataatgca

SEQ ID NO: 12503 - DNA, 20 bp, Artificial Sequence
  Description of Artificial Sequence: Synthetic oligonucleotide
  Target: ANGPTL3; (-) strand; PAM type: YTN; PAM sequence: CTG
aaagtctgattatcctttct

SEQ ID NO: 12504 - DNA, 20 bp, Artificial Sequence
  Description of Artificial Sequence: Synthetic oligonucleotide
  Target: ANGPTL3; (-) strand; PAM type: YTN; PAM sequence: TTA
atataactgaaagtctgatt

SEQ ID NO: 12505 - DNA, 20 bp, Artificial Sequence
  Description of Artificial Sequence: Synthetic oligonucleotide
  Target: ANGPTL3; (-) strand; PAM type: YTN; PAM sequence: TTA
aaaatattaatataactgaa

SEQ ID NO: 12506 - DNA, 20 bp, Artificial Sequence
  Description of Artificial Sequence: Synthetic oligonucleotide
  Target: ANGPTL3; (-) strand; PAM type: YTN; PAM sequence: CTA
tgtgcacaaaaatgttaaaa

SEQ ID NO: 12507 - DNA, 20 bp, Artificial Sequence
  Description of Artificial Sequence: Synthetic oligonucleotide
  Target: ANGPTL3; (-) strand; PAM type: YTN; PAM sequence: TTG
aagatagctatgtgcacaaa

SEQ ID NO: 12508 - DNA, 20 bp, Artificial Sequence
  Description of Artificial Sequence: Synthetic oligonucleotide
  Target: ANGPTL3; (-) strand; PAM type: YTN; PAM sequence: TTA
ttgaagatagctatgtgcac

SEQ ID NO: 12509 - DNA, 20 bp, Artificial Sequence
  Description of Artificial Sequence: Synthetic oligonucleotide
  Target: ANGPTL3; (-) strand; PAM type: YTN; PAM sequence: TTT
attgaagatagctatgtgca

SEQ ID NO: 12510 - DNA, 20 bp, Artificial Sequence
  Description of Artificial Sequence: Synthetic oligonucleotide
  Target: ANGPTL3; (-) strand; PAM type: YTN; PAM sequence: TTT
tattgaagatagctatgtgc

SEQ ID NO: 12511 - DNA, 20 bp, Artificial Sequence
  Description of Artificial Sequence: Synthetic oligonucleotide
  Target: ANGPTL3; (-) strand; PAM type: YTN; PAM sequence: TTA
aaacaattttattgaagata

SEQ ID NO: 12512 - DNA, 20 bp, Artificial Sequence
  Description of Artificial Sequence: Synthetic oligonucleotide
  Target: ANGPTL3; (-) strand; PAM type: YTN; PAM sequence: TTT
aaaacaattttattgaagat

SEQ ID NO: 12513 - DNA, 20 bp, Artificial Sequence
  Description of Artificial Sequence: Synthetic oligonucleotide
  Target: ANGPTL3; (-) strand; PAM type: YTN; PAM sequence: TTT
taaaacaattttattgaaga

SEQ ID NO: 12514 - DNA, 20 bp, Artificial Sequence
  Description of Artificial Sequence: Synthetic oligonucleotide
  Target: ANGPTL3; (-) strand; PAM type: YTN; PAM sequence: CTT
ttaaaacaattttattgaag

SEQ ID NO: 12515 - DNA, 20 bp, Artificial Sequence
  Description of Artificial Sequence: Synthetic oligonucleotide
  Target: ANGPTL3; (-) strand; PAM type: YTN; PAM sequence: TTA
aaataataccttttaaaaca

SEQ ID NO: 12516 - DNA, 20 bp, Artificial Sequence
  Description of Artificial Sequence: Synthetic oligonucleotide
  Target: ANGPTL3; (-) strand; PAM type: YTN; PAM sequence: CTT
aaaataataccttttaaaac

SEQ ID NO: 12517 - DNA, 20 bp, Artificial Sequence
  Description of Artificial Sequence: Synthetic oligonucleotide
  Target: ANGPTL3; (-) strand; PAM type: YTN; PAM sequence: TTA
gtgtatcttaaaataatacc

SEQ ID NO: 12518 - DNA, 20 bp, Artificial Sequence
  Description of Artificial Sequence: Synthetic oligonucleotide
  Target: ANGPTL3; (-) strand; PAM type: YTN; PAM sequence: TTT
agtgtatcttaaaataatac

SEQ ID NO: 12519 - DNA, 20 bp, Artificial Sequence
  Description of Artificial Sequence: Synthetic oligonucleotide
  Target: ANGPTL3; (-) strand; PAM type: YTN; PAM sequence: TTT
tagtgtatcttaaaataata

SEQ ID NO: 12520 - DNA, 20 bp, Artificial Sequence
  Description of Artificial Sequence: Synthetic oligonucleotide
  Target: ANGPTL3; (-) strand; PAM type: YTN; PAM sequence: TTG
atcattttagtgtatcttaa

SEQ ID NO: 12521 - DNA, 20 bp, Artificial Sequence
  Description of Artificial Sequence: Synthetic oligonucleotide
  Target: ANGPTL3; (-) strand; PAM type: YTN; PAM sequence: CTT
gatcattttagtgtatctta

SEQ ID NO: 12522 - DNA, 20 bp, Artificial Sequence
  Description of Artificial Sequence: Synthetic oligonucleotide
  Target: ANGPTL3; (-) strand; PAM type: YTN; PAM sequence: TTG
aatcccttgatcattttagt

SEQ ID NO: 12523 - DNA, 20 bp, Artificial Sequence
  Description of Artificial Sequence: Synthetic oligonucleotide
  Target: ANGPTL3; (-) strand; PAM type: YTN; PAM sequence: CTT
gaatcccttgatcattttag

SEQ ID NO: 12524 - DNA, 20 bp, Artificial Sequence
  Description of Artificial Sequence: Synthetic oligonucleotide
  Target: ANGPTL3; (-) strand; PAM type: YTN; PAM sequence: TTA
gtcttgaatcccttgatcat

SEQ ID NO: 12525 - DNA, 20 bp, Artificial Sequence
  Description of Artificial Sequence: Synthetic oligonucleotide
  Target: ANGPTL3; (-) strand; PAM type: YTN; PAM sequence: TTT
agtcttgaatcccttgatca

SEQ ID NO: 12526 - DNA, 20 bp, Artificial Sequence
  Description of Artificial Sequence: Synthetic oligonucleotide
  Target: ANGPTL3; (-) strand; PAM type: YTN; PAM sequence: TTG
tttagtcttgaatcccttga

SEQ ID NO: 12527 - DNA, 20 bp, Artificial Sequence
  Description of Artificial Sequence: Synthetic oligonucleotide
  Target: ANGPTL3; (-) strand; PAM type: YTN; PAM sequence: TTG
agttgtttagtcttgaatcc

SEQ ID NO: 12528 - DNA, 20 bp, Artificial Sequence
  Description of Artificial Sequence: Synthetic oligonucleotide
  Target: ANGPTL3; (-) strand; PAM type: YTN; PAM sequence: CTA
attgagttgtttagtcttga

SEQ ID NO: 12529 - DNA, 20 bp, Artificial Sequence
  Description of Artificial Sequence: Synthetic oligonucleotide
  Target: ANGPTL3; (-) strand; PAM type: YTN; PAM sequence: TTG
gtgcaactaattgagttgtt

SEQ ID NO: 12530 - DNA, 20 bp, Artificial Sequence
  Description of Artificial Sequence: Synthetic oligonucleotide
  Target: ANGPTL3; (-) strand; PAM type: YTN; PAM sequence: TTA
ttggtgcaactaattgagtt

SEQ ID NO: 12531 - DNA, 20 bp, Artificial Sequence
  Description of Artificial Sequence: Synthetic oligonucleotide
  Target: ANGPTL3; (-) strand; PAM type: YTN; PAM sequence: TTT
attggtgcaactaattgagt

SEQ ID NO: 12532 - DNA, 20 bp, Artificial Sequence
  Description of Artificial Sequence: Synthetic oligonucleotide
  Target: ANGPTL3; (-) strand; PAM type: YTN; PAM sequence: TTT
tattggtgcaactaattgag

SEQ ID NO: 12533 - DNA, 20 bp, Artificial Sequence
  Description of Artificial Sequence: Synthetic oligonucleotide
  Target: ANGPTL3; (-) strand; PAM type: YTN; PAM sequence: TTT
ttattggtgcaactaattga

SEQ ID NO: 12534 - DNA, 20 bp, Artificial Sequence
  Description of Artificial Sequence: Synthetic oligonucleotide
  Target: ANGPTL3; (-) strand; PAM type: YTN; PAM sequence: TTT
tttattggtgcaactaattg

SEQ ID NO: 12535 - DNA, 20 bp, Artificial Sequence
  Description of Artificial Sequence: Synthetic oligonucleotide
  Target: ANGPTL3; (-) strand; PAM type: YTN; PAM sequence: TTA
agtgttttttattggtgcaa

SEQ ID NO: 12536 - DNA, 20 bp, Artificial Sequence
  Description of Artificial Sequence: Synthetic oligonucleotide
  Target: ANGPTL3; (-) strand; PAM type: YTN; PAM sequence: TTT
aagtgttttttattggtgca

SEQ ID NO: 12537 - DNA, 20 bp, Artificial Sequence
  Description of Artificial Sequence: Synthetic oligonucleotide
  Target: ANGPTL3; (-) strand; PAM type: YTN; PAM sequence: TTT
taagtgttttttattggtgc

SEQ ID NO: 12538 - DNA, 20 bp, Artificial Sequence
  Description of Artificial Sequence: Synthetic oligonucleotide
  Target: ANGPTL3; (-) strand; PAM type: YTN; PAM sequence: TTT
ttaagtgttttttattggtg

SEQ ID NO: 12539 - DNA, 20 bp, Artificial Sequence
  Description of Artificial Sequence: Synthetic oligonucleotide
  Target: ANGPTL3; (-) strand; PAM type: YTN; PAM sequence: TTT
tttaagtgttttttattggt

SEQ ID NO: 12540 - DNA, 20 bp, Artificial Sequence
  Description of Artificial Sequence: Synthetic oligonucleotide
  Target: ANGPTL3; (-) strand; PAM type: YTN; PAM sequence: TTT
ttttaagtgttttttattgg

SEQ ID NO: 12541 - DNA, 20 bp, Artificial Sequence
  Description of Artificial Sequence: Synthetic oligonucleotide
  Target: ANGPTL3; (-) strand; PAM type: YTN; PAM sequence: CTG
acagtttttttaagtgtttt

SEQ ID NO: 12542 - DNA, 20 bp, Artificial Sequence
  Description of Artificial Sequence: Synthetic oligonucleotide
  Target: ANGPTL3; (-) strand; PAM type: YTN; PAM sequence: TTG
gacactgacagtttttttaa

SEQ ID NO: 12543 - DNA, 20 bp, Artificial Sequence
  Description of Artificial Sequence: Synthetic oligonucleotide
  Target: ANGPTL3; (-) strand; PAM type: YTN; PAM sequence: TTA
agtacaggttggacactgac

SEQ ID NO: 12544 - DNA, 20 bp, Artificial Sequence
  Description of Artificial Sequence: Synthetic oligonucleotide
  Target: ANGPTL3; (-) strand; PAM type: YTN; PAM sequence: TTA
ttaagtacaggttggacact

SEQ ID NO: 12545 - DNA, 20 bp, Artificial Sequence
  Description of Artificial Sequence: Synthetic oligonucleotide
  Target: ANGPTL3; (-) strand; PAM type: YTN; PAM sequence: CTG
tgagttattaagtacaggtt

SEQ ID NO: 12546 - DNA, 20 bp, Artificial Sequence
  Description of Artificial Sequence: Synthetic oligonucleotide
  Target: ANGPTL3; (-) strand; PAM type: YTN; PAM sequence: TTA
aaaatctgtgagttattaag

SEQ ID NO: 12547 - DNA, 20 bp, Artificial Sequence
  Description of Artificial Sequence: Synthetic oligonucleotide
  Target: ANGPTL3; (-) strand; PAM type: YTN; PAM sequence: TTT
aaaaatctgtgagttattaa

SEQ ID NO: 12548 - DNA, 20 bp, Artificial Sequence
  Description of Artificial Sequence: Synthetic oligonucleotide
  Target: ANGPTL3; (-) strand; PAM type: YTN; PAM sequence: TTT
taaaaatctgtgagttatta

SEQ ID NO: 12549 - DNA, 20 bp, Artificial Sequence
  Description of Artificial Sequence: Synthetic oligonucleotide
  Target: ANGPTL3; (-) strand; PAM type: YTN; PAM sequence: CTG
aaaagaaaagttttaaaaat

SEQ ID NO: 12550 - DNA, 20 bp, Artificial Sequence
  Description of Artificial Sequence: Synthetic oligonucleotide
  Target: ANGPTL3; (-) strand; PAM type: YTN; PAM sequence: CTC
ctgaaaagaaaagttttaaa

SEQ ID NO: 12551 - DNA, 20 bp, Artificial Sequence
  Description of Artificial Sequence: Synthetic oligonucleotide
  Target: ANGPTL3; (-) strand; PAM type: YTN; PAM sequence: TTC
tcctgaaaagaaaagtttta

SEQ ID NO: 12552 - DNA, 20 bp, Artificial Sequence
  Description of Artificial Sequence: Synthetic oligonucleotide
  Target: ANGPTL3; (-) strand; PAM type: YTN; PAM sequence: CTA
ggcccaaccaaaattctcct

SEQ ID NO: 12553 - DNA, 20 bp, Artificial Sequence
  Description of Artificial Sequence: Synthetic oligonucleotide
  Target: ANGPTL3; (-) strand; PAM type: YTN; PAM sequence: CTC
taggcccaaccaaaattctc

SEQ ID NO: 12554 - DNA, 20 bp, Artificial Sequence
  Description of Artificial Sequence: Synthetic oligonucleotide
  Target: ANGPTL3; (-) strand; PAM type: YTN; PAM sequence: TTC
tctaggcccaaccaaaattc

SEQ ID NO: 12555 - DNA, 20 bp, Artificial Sequence
  Description of Artificial Sequence: Synthetic oligonucleotide
  Target: ANGPTL3; (-) strand; PAM type: YTN; PAM sequence: CTT
ctctaggcccaaccaaaatt

SEQ ID NO: 12556 - DNA, 20 bp, Artificial Sequence
  Description of Artificial Sequence: Synthetic oligonucleotide
  Target: ANGPTL3; (-) strand; PAM type: YTN; PAM sequence: CTA
tggagtatatcttctctagg

SEQ ID NO: 12557 - DNA, 20 bp, Artificial Sequence
  Description of Artificial Sequence: Synthetic oligonucleotide
  Target: ANGPTL3; (-) strand; PAM type: YTN; PAM sequence: TTC
actatggagtatatcttctc

SEQ ID NO: 12558 - DNA, 20 bp, Artificial Sequence
  Description of Artificial Sequence: Synthetic oligonucleotide
  Target: ANGPTL3; (-) strand; PAM type: YTN; PAM sequence: CTT
cactatggagtatatcttct

SEQ ID NO: 12559 - DNA, 20 bp, Artificial Sequence
  Description of Artificial Sequence: Synthetic oligonucleotide
  Target: ANGPTL3; (-) strand; PAM type: YTN; PAM sequence: TTG
cttcactatggagtatatct

SEQ ID NO: 12560 - DNA, 20 bp, Artificial Sequence
  Description of Artificial Sequence: Synthetic oligonucleotide
  Target: ANGPTL3; (-) strand; PAM type: YTN; PAM sequence: TTA
gattgcttcactatggagta

SEQ ID NO: 12561 - DNA, 20 bp, Artificial Sequence
  Description of Artificial Sequence: Synthetic oligonucleotide
  Target: ANGPTL3; (-) strand; PAM type: YTN; PAM sequence: TTC
gtaaaacataattagattgc

SEQ ID NO: 12562 - DNA, 20 bp, Artificial Sequence
  Description of Artificial Sequence: Synthetic oligonucleotide
  Target: ANGPTL3; (-) strand; PAM type: YTN; PAM sequence: CTC
aattcgtaaaacataattag

SEQ ID NO: 12563 - DNA, 20 bp, Artificial Sequence
  Description of Artificial Sequence: Synthetic oligonucleotide
  Target: ANGPTL3; (-) strand; PAM type: YTN; PAM sequence: TTC
caactcaattcgtaaaacat

SEQ ID NO: 12564 - DNA, 20 bp, Artificial Sequence
  Description of Artificial Sequence: Synthetic oligonucleotide
  Target: ANGPTL3; (-) strand; PAM type: YTN; PAM sequence: CTT
ccaactcaattcgtaaaaca

SEQ ID NO: 12565 - DNA, 20 bp, Artificial Sequence
  Description of Artificial Sequence: Synthetic oligonucleotide
  Target: ANGPTL3; (-) strand; PAM type: YTN; PAM sequence: TTC
cagtcttccaactcaattcg

SEQ ID NO: 12566 - DNA, 20 bp, Artificial Sequence
  Description of Artificial Sequence: Synthetic oligonucleotide
  Target: ANGPTL3; (-) strand; PAM type: YTN; PAM sequence: TTT
ccagtcttccaactcaattc

SEQ ID NO: 12567 - DNA, 20 bp, Artificial Sequence
  Description of Artificial Sequence: Synthetic oligonucleotide
  Target: ANGPTL3; (-) strand; PAM type: YTN; PAM sequence: CTT
tccagtcttccaactcaatt

SEQ ID NO: 12568 - DNA, 20 bp, Artificial Sequence
  Description of Artificial Sequence: Synthetic oligonucleotide
  Target: ANGPTL3; (-) strand; PAM type: YTN; PAM sequence: TTG
tctttccagtcttccaactc

SEQ ID NO: 12569 - DNA, 20 bp, Artificial Sequence
  Description of Artificial Sequence: Synthetic oligonucleotide
  Target: ANGPTL3; (-) strand; PAM type: YTN; PAM sequence: TTG
ttgtctttccagtcttccaa

SEQ ID NO: 12570 - DNA, 20 bp, Artificial Sequence
  Description of Artificial Sequence: Synthetic oligonucleotide
  Target: ANGPTL3; (-) strand; PAM type: YTN; PAM sequence: TTT
gttgtctttccagtcttcca

SEQ ID NO: 12571 - DNA, 20 bp, Artificial Sequence
  Description of Artificial Sequence: Synthetic oligonucleotide
  Target: ANGPTL3; (-) strand; PAM type: YTN; PAM sequence: TTC
aatataatgtttgttgtctt

SEQ ID NO: 12572 - DNA, 20 bp, Artificial Sequence
  Description of Artificial Sequence: Synthetic oligonucleotide
  Target: ANGPTL3; (-) strand; PAM type: YTN; PAM sequence: TTC
ccaagtaaaaagaatattca

SEQ ID NO: 12573 - DNA, 20 bp, Artificial Sequence
  Description of Artificial Sequence: Synthetic oligonucleotide
  Target: ANGPTL3; (-) strand; PAM type: YTN; PAM sequence: TTT
cccaagtaaaaagaatattc

SEQ ID NO: 12574 - DNA, 20 bp, Artificial Sequence
  Description of Artificial Sequence: Synthetic oligonucleotide
  Target: ANGPTL3; (-) strand; PAM type: YTN; PAM sequence: TTC
gtgatttcccaagtaaaaag

SEQ ID NO: 12575 - DNA, 20 bp, Artificial Sequence
  Description of Artificial Sequence: Synthetic oligonucleotide
  Target: ANGPTL3; (-) strand; PAM type: YTN; PAM sequence: TTT
cgtgatttcccaagtaaaaa

SEQ ID NO: 12576 - DNA, 20 bp, Artificial Sequence
  Description of Artificial Sequence: Synthetic oligonucleotide
  Target: ANGPTL3; (-) strand; PAM type: YTN; PAM sequence: TTG
gtttcgtgatttcccaagta

SEQ ID NO: 12577 - DNA, 20 bp, Artificial Sequence
  Description of Artificial Sequence: Synthetic oligonucleotide
  Target: ANGPTL3; (-) strand; PAM type: YTN; PAM sequence: CTA
gatgtagcgtatagttggtt

SEQ ID NO: 12578 - DNA, 20 bp, Artificial Sequence
  Description of Artificial Sequence: Synthetic oligonucleotide
  Target: ANGPTL3; (-) strand; PAM type: YTN; PAM sequence: TTG
ccagtaatcgcaactagatg

SEQ ID NO: 12579 - DNA, 20 bp, Artificial Sequence
  Description of Artificial Sequence: Synthetic oligonucleotide
  Target: ANGPTL3; (-) strand; PAM type: YTN; PAM sequence: TTG
gggacattgccagtaatcgc

SEQ ID NO: 12580 - DNA, 20 bp, Artificial Sequence
  Description of Artificial Sequence: Synthetic oligonucleotide
  Target: ANGPTL3; (-) strand; PAM type: YTN; PAM sequence: TTG
cattggggacattgccagta

SEQ ID NO: 12581 - DNA, 20 bp, Artificial Sequence
  Description of Artificial Sequence: Synthetic oligonucleotide
  Target: ANGPTL3; (-) strand; PAM type: YTN; PAM sequence: TTC
cgggattgcattggggacat

SEQ ID NO: 12582 - DNA, 20 bp, Artificial Sequence
  Description of Artificial Sequence: Synthetic oligonucleotide
  Target: ANGPTL3; (-) strand; PAM type: YTN; PAM sequence: TTT
ccgggattgcattggggaca

SEQ ID NO: 12583 - DNA, 20 bp, Artificial Sequence
  Description of Artificial Sequence: Synthetic oligonucleotide
  Target: ANGPTL3; (-) strand; PAM type: YTN; PAM sequence: TTT
tccgggattgcattggggac

SEQ ID NO: 12584 - DNA, 20 bp, Artificial Sequence
  Description of Artificial Sequence: Synthetic oligonucleotide
  Target: ANGPTL3; (-) strand; PAM type: YTN; PAM sequence: TTG
ttttccgggattgcattggg

SEQ ID NO: 12585 - DNA, 20 bp, Artificial Sequence
  Description of Artificial Sequence: Synthetic oligonucleotide
  Target: ANGPTL3; (-) strand; PAM type: YTN; PAM sequence: TTT
gttttccgggattgcattgg

SEQ ID NO: 12586 - DNA, 20 bp, Artificial Sequence
  Description of Artificial Sequence: Synthetic oligonucleotide
  Target: ANGPTL3; (-) strand; PAM type: YTN; PAM sequence: CTT
tgttttccgggattgcattg

SEQ ID NO: 12587 - DNA, 20 bp, Artificial Sequence
  Description of Artificial Sequence: Synthetic oligonucleotide
  Target: ANGPTL3; (-) strand; PAM type: YTN; PAM sequence: TTG
tgatcccaagtagaaaacac

SEQ ID NO: 12588 - DNA, 20 bp, Artificial Sequence
  Description of Artificial Sequence: Synthetic oligonucleotide
  Target: ANGPTL3; (-) strand; PAM type: YTN; PAM sequence: TTT
gtgatcccaagtagaaaaca

SEQ ID NO: 12589 - DNA, 20 bp, Artificial Sequence
  Description of Artificial Sequence: Synthetic oligonucleotide
  Target: ANGPTL3; (-) strand; PAM type: YTN; PAM sequence: CTT
tgtgatcccaagtagaaaac

SEQ ID NO: 12590 - DNA, 20 bp, Artificial Sequence
  Description of Artificial Sequence: Synthetic oligonucleotide
  Target: ANGPTL3; (-) strand; PAM type: YTN; PAM sequence: TTG
ctttgtgatcccaagtagaa

SEQ ID NO: 12591 - DNA, 20 bp, Artificial Sequence
  Description of Artificial Sequence: Synthetic oligonucleotide
  Target: ANGPTL3; (-) strand; PAM type: YTN; PAM sequence: TTT
gctttgtgatcccaagtaga

SEQ ID NO: 12592 - DNA, 20 bp, Artificial Sequence
  Description of Artificial Sequence: Synthetic oligonucleotide
  Target: ANGPTL3; (-) strand; PAM type: YTN; PAM sequence: TTT
tgctttgtgatcccaagtag

SEQ ID NO: 12593 - DNA, 20 bp, Artificial Sequence
  Description of Artificial Sequence: Synthetic oligonucleotide
  Target: ANGPTL3; (-) strand; PAM type: YTN; PAM sequence: CTT
ttgctttgtgatcccaagta

SEQ ID NO: 12594 - DNA, 20 bp, Artificial Sequence
  Description of Artificial Sequence: Synthetic oligonucleotide
  Target: ANGPTL3; (-) strand; PAM type: YTN; PAM sequence: TTG
aagtgtccttttgctttgtg

SEQ ID NO: 12595 - DNA, 20 bp, Artificial Sequence
  Description of Artificial Sequence: Synthetic oligonucleotide
  Target: ANGPTL3; (-) strand; PAM type: YTN; PAM sequence: CTG
gacagttgaagtgtcctttt

SEQ ID NO: 12596 - DNA, 20 bp, Artificial Sequence
  Description of Artificial Sequence: Synthetic oligonucleotide
  Target: ANGPTL3; (-) strand; PAM type: YTN; PAM sequence: CTC
tggacagttgaagtgtcctt

SEQ ID NO: 12597 - DNA, 20 bp, Artificial Sequence
  Description of Artificial Sequence: Synthetic oligonucleotide
  Target: ANGPTL3; (-) strand; PAM type: YTN; PAM sequence: CTG
aataaccctctggacagttg

SEQ ID NO: 12598 - DNA, 20 bp, Artificial Sequence
  Description of Artificial Sequence: Synthetic oligonucleotide
  Target: ANGPTL3; (-) strand; PAM type: YTN; PAM sequence: TTG
gtatcagaaaaagatacctg

SEQ ID NO: 12599 - DNA, 20 bp, Artificial Sequence
  Description of Artificial Sequence: Synthetic oligonucleotide
  Target: ANGPTL3; (-) strand; PAM type: YTN; PAM sequence: TTG
aagatatgaaaataaagtat

SEQ ID NO: 12600 - DNA, 20 bp, Artificial Sequence
  Description of Artificial Sequence: Synthetic oligonucleotide
  Target: ANGPTL3; (-) strand; PAM type: YTN; PAM sequence: TTT
gaagatatgaaaataaagta

SEQ ID NO: 12601 - DNA, 20 bp, Artificial Sequence
  Description of Artificial Sequence: Synthetic oligonucleotide
  Target: ANGPTL3; (-) strand; PAM type: YTN; PAM sequence: CTT
tgaagatatgaaaataaagt

SEQ ID NO: 12602 - DNA, 20 bp, Artificial Sequence
  Description of Artificial Sequence: Synthetic oligonucleotide
  Target: ANGPTL3; (-) strand; PAM type: YTN; PAM sequence: CTA
ataatgtgggaagatacttt

SEQ ID NO: 12603 - DNA, 20 bp, Artificial Sequence
  Description of Artificial Sequence: Synthetic oligonucleotide
  Target: ANGPTL3; (-) strand; PAM type: YTN; PAM sequence: TTG
cagataatagctaataatgt

SEQ ID NO: 12604 - DNA, 20 bp, Artificial Sequence
  Description of Artificial Sequence: Synthetic oligonucleotide
  Target: ANGPTL3; (-) strand; PAM type: YTN; PAM sequence: TTG
tcattgcagataatagctaa

SEQ ID NO: 12605 - DNA, 20 bp, Artificial Sequence
  Description of Artificial Sequence: Synthetic oligonucleotide
  Target: ANGPTL3; (-) strand; PAM type: YTN; PAM sequence: TTA
aaagttgtcattgcagataa

SEQ ID NO: 12606 - DNA, 20 bp, Artificial Sequence
  Description of Artificial Sequence: Synthetic oligonucleotide
  Target: ANGPTL3; (-) strand; PAM type: YTN; PAM sequence: TTT
aaaagttgtcattgcagata

SEQ ID NO: 12607 - DNA, 20 bp, Artificial Sequence
  Description of Artificial Sequence: Synthetic oligonucleotide
  Target: ANGPTL3; (-) strand; PAM type: YTN; PAM sequence: TTT
taaaagttgtcattgcagat

SEQ ID NO: 12608 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaagttgtcattgcaga

SEQ ID NO: 12609 - DNA, 20 bp, Artificial Sequence
  Description of Artificial Sequence: Synthetic oligonucleotide
  Target: ANGPTL3; (-) strand; PAM type: YTN; PAM sequence: TTC
ggatttttaaaagttgtcat

SEQ ID NO: 12610 - DNA, 20 bp, Artificial Sequence
  Description of Artificial Sequence: Synthetic oligonucleotide
  Target: ANGPTL3; (-) strand; PAM type: YTN; PAM sequence: TTG
ggattcggatttttaaaagt

SEQ ID NO: 12611 - DNA, 20 bp, Artificial Sequence
  Description of Artificial Sequence: Synthetic oligonucleotide
  Target: ANGPTL3; (-) strand; PAM type: YTN; PAM sequence: TTT
gggattcggatttttaaaag

SEQ ID NO: 12612 - DNA, 20 bp, Artificial Sequence
  Description of Artificial Sequence: Synthetic oligonucleotide
  Target: ANGPTL3; (-) strand; PAM type: YTN; PAM sequence: TTA
tttgggattcggatttttaa

SEQ ID NO: 12613 - DNA, 20 bp, Artificial Sequence
  Description of Artificial Sequence: Synthetic oligonucleotide
  Target: ANGPTL3; (-) strand; PAM type: YTN; PAM sequence: CTT
atttgggattcggattttta

SEQ ID NO: 12614 - DNA, 20 bp, Artificial Sequence
  Description of Artificial Sequence: Synthetic oligonucleotide
  Target: ANGPTL3; (-) strand; PAM type: YTN; PAM sequence: CTA
gagagaaaacgcttatttgg

SEQ ID NO: 12615 - DNA, 20 bp, Artificial Sequence
  Description of Artificial Sequence: Synthetic oligonucleotide
  Target: ANGPTL3; (-) strand; PAM type: YTN; PAM sequence: TTC
gtctagagagaaaacgctta

SEQ ID NO: 12616 - DNA, 20 bp, Artificial Sequence
  Description of Artificial Sequence: Synthetic oligonucleotide
  Target: ANGPTL3; (-) strand; PAM type: YTN; PAM sequence: TTT
cgtctagagagaaaacgctt

SEQ ID NO: 12617 - DNA, 20 bp, Artificial Sequence
  Description of Artificial Sequence: Synthetic oligonucleotide
  Target: ANGPTL3; (-) strand; PAM type: YTN; PAM sequence: TTT
tcgtctagagagaaaacgct

SEQ ID NO: 12618 - DNA, 20 bp, Artificial Sequence
  Description of Artificial Sequence: Synthetic oligonucleotide
  Target: ANGPTL3; (-) strand; PAM type: YTN; PAM sequence: TTA
agaggttttcgtctagagag

SEQ ID NO: 12619 - DNA, 20 bp, Artificial Sequence
  Description of Artificial Sequence: Synthetic oligonucleotide
  Target: ANGPTL3; (-) strand; PAM type: YTN; PAM sequence: TTA
tagttaagaggttttcgtct

SEQ ID NO: 12620 - DNA, 20 bp, Artificial Sequence
  Description of Artificial Sequence: Synthetic oligonucleotide
  Target: ANGPTL3; (-) strand; PAM type: YTN; PAM sequence: TTC
attatagttaagaggttttc

SEQ ID NO: 12621 - DNA, 20 bp, Artificial Sequence
  Description of Artificial Sequence: Synthetic oligonucleotide
  Target: ANGPTL3; (-) strand; PAM type: YTN; PAM sequence: TTT
cattatagttaagaggtttt

SEQ ID NO: 12622 - DNA, 20 bp, Artificial Sequence
  Description of Artificial Sequence: Synthetic oligonucleotide
  Target: ANGPTL3; (-) strand; PAM type: YTN; PAM sequence: CTT
tcattatagttaagaggttt

SEQ ID NO: 12623 - DNA, 20 bp, Artificial Sequence
  Description of Artificial Sequence: Synthetic oligonucleotide
  Target: ANGPTL3; (-) strand; PAM type: YTN; PAM sequence: CTA
gaatgaacactttcattata

SEQ ID NO: 12624 - DNA, 20 bp, Artificial Sequence
  Description of Artificial Sequence: Synthetic oligonucleotide
  Target: ANGPTL3; (-) strand; PAM type: YTN; PAM sequence: TTG
aactagaatgaacactttca

SEQ ID NO: 12625 - DNA, 20 bp, Artificial Sequence
  Description of Artificial Sequence: Synthetic oligonucleotide
  Target: ANGPTL3; (-) strand; PAM type: YTN; PAM sequence: CTG
attgaactagaatgaacact

SEQ ID NO: 12626 - DNA, 20 bp, Artificial Sequence
  Description of Artificial Sequence: Synthetic oligonucleotide
  Target: ANGPTL3; (-) strand; PAM type: YTN; PAM sequence: TTA
gaggtaaaatacctgattga

SEQ ID NO: 12627 - DNA, 20 bp, Artificial Sequence
  Description of Artificial Sequence: Synthetic oligonucleotide
  Target: ANGPTL3; (-) strand; PAM type: YTN; PAM sequence: CTG
aggaagattagaggtaaaat

SEQ ID NO: 12628 - DNA, 20 bp, Artificial Sequence
  Description of Artificial Sequence: Synthetic oligonucleotide
  Target: ANGPTL3; (-) strand; PAM type: YTN; PAM sequence: CTA
ccaaaaaatagaaaatctga

SEQ ID NO: 12629 - DNA, 20 bp, Artificial Sequence
  Description of Artificial Sequence: Synthetic oligonucleotide
  Target: ANGPTL3; (-) strand; PAM type: YTN; PAM sequence: CTA
tacactaccaaaaaatagaa

SEQ ID NO: 12630 - DNA, 20 bp, Artificial Sequence
  Description of Artificial Sequence: Synthetic oligonucleotide
  Target: ANGPTL3; (-) strand; PAM type: YTN; PAM sequence: CTG
tataaataatctatacacta

SEQ ID NO: 12631 - DNA, 20 bp, Artificial Sequence
  Description of Artificial Sequence: Synthetic oligonucleotide
  Target: ANGPTL3; (-) strand; PAM type: YTN; PAM sequence: TTA
aataatctgtataaataatc

SEQ ID NO: 12632 - DNA, 20 bp, Artificial Sequence
  Description of Artificial Sequence: Synthetic oligonucleotide
  Target: ANGPTL3; (-) strand; PAM type: YTN; PAM sequence: TTT
aaataatctgtataaataat

SEQ ID NO: 12633 - DNA, 20 bp, Artificial Sequence
  Description of Artificial Sequence: Synthetic oligonucleotide
  Target: ANGPTL3; (-) strand; PAM type: YTN; PAM sequence: TTT
taaataatctgtataaataa

SEQ ID NO: 12634 - DNA, 20 bp, Artificial Sequence
  Description of Artificial Sequence: Synthetic oligonucleotide
  Target: ANGPTL3; (-) strand; PAM type: YTN; PAM sequence: CTG
tataagtcccaattttaaat

SEQ ID NO: 12635 - DNA, 20 bp, Artificial Sequence
  Description of Artificial Sequence: Synthetic oligonucleotide
  Target: ANGPTL3; (-) strand; PAM type: YTN; PAM sequence: TTA
aataatctgtataagtccca

SEQ ID NO: 12636 - DNA, 20 bp, Artificial Sequence
  Description of Artificial Sequence: Synthetic oligonucleotide
  Target: ANGPTL3; (-) strand; PAM type: YTN; PAM sequence: TTT
aaataatctgtataagtccc

SEQ ID NO: 12637 - DNA, 20 bp, Artificial Sequence
  Description of Artificial Sequence: Synthetic oligonucleotide
  Target: ANGPTL3; (-) strand; PAM type: YTN; PAM sequence: TTT
taaataatctgtataagtcc

SEQ ID NO: 12638 - DNA, 20 bp, Artificial Sequence
  Description of Artificial Sequence: Synthetic oligonucleotide
  Target: ANGPTL3; (-) strand; PAM type: YTN; PAM sequence: TTA
gatgcatgtatcccagtttt

SEQ ID NO: 12639 - DNA, 20 bp, Artificial Sequence
  Description of Artificial Sequence: Synthetic oligonucleotide
  Target: ANGPTL3; (-) strand; PAM type: YTN; PAM sequence: TTT
agatgcatgtatcccagttt

SEQ ID NO: 12640 - DNA, 20 bp, Artificial Sequence
  Description of Artificial Sequence: Synthetic oligonucleotide
  Target: ANGPTL3; (-) strand; PAM type: YTN; PAM sequence: TTT
tagatgcatgtatcccagtt

SEQ ID NO: 12641 - DNA, 20 bp, Artificial Sequence
  Description of Artificial Sequence: Synthetic oligonucleotide
  Target: ANGPTL3; (-) strand; PAM type: YTN; PAM sequence: TTA
cagtgttttagatgcatgta

SEQ ID NO: 12642 - DNA, 20 bp, Artificial Sequence
  Description of Artificial Sequence: Synthetic oligonucleotide
  Target: ANGPTL3; (-) strand; PAM type: YTN; PAM sequence: TTA
taaatattacagtgttttag

SEQ ID NO: 12643 - DNA, 20 bp, Artificial Sequence
  Description of Artificial Sequence: Synthetic oligonucleotide
  Target: ANGPTL3; (-) strand; PAM type: YTN; PAM sequence: CTT
ataaatattacagtgtttta

SEQ ID NO: 12644 - DNA, 20 bp, Artificial Sequence
  Description of Artificial Sequence: Synthetic oligonucleotide
  Target: ANGPTL3; (-) strand; PAM type: YTN; PAM sequence: TTC
ttataaatattacagtgttt

SEQ ID NO: 12645 - DNA, 20 bp, Artificial Sequence
  Description of Artificial Sequence: Synthetic oligonucleotide
  Target: ANGPTL3; (-) strand; PAM type: YTN; PAM sequence: TTT
cttataaatattacagtgtt

SEQ ID NO: 12646 - DNA, 20 bp, Artificial Sequence
  Description of Artificial Sequence: Synthetic oligonucleotide
  Target: ANGPTL3; (-) strand; PAM type: YTN; PAM sequence: CTT
tcttataaatattacagtgt

SEQ ID NO: 12647 - DNA, 20 bp, Artificial Sequence
  Description of Artificial Sequence: Synthetic oligonucleotide
  Target: ANGPTL3; (-) strand; PAM type: YTN; PAM sequence: TTC
ctttcttataaatattacag

SEQ ID NO: 12648 - DNA, 20 bp, Artificial Sequence
  Description of Artificial Sequence: Synthetic oligonucleotide
  Target: ANGPTL3; (-) strand; PAM type: YTN; PAM sequence: CTT
cctttcttataaatattaca

SEQ ID NO: 12649 - DNA, 20 bp, Artificial Sequence
  Description of Artificial Sequence: Synthetic oligonucleotide
  Target: ANGPTL3; (-) strand; PAM type: YTN; PAM sequence: TTA
tcttcctttcttataaatat

SEQ ID NO: 12650 - DNA, 20 bp, Artificial Sequence
  Description of Artificial Sequence: Synthetic oligonucleotide
  Target: ANGPTL3; (-) strand; PAM type: YTN; PAM sequence: TTT
atcttcctttcttataaata

SEQ ID NO: 12651 - DNA, 20 bp, Artificial Sequence
  Description of Artificial Sequence: Synthetic oligonucleotide
  Target: ANGPTL3; (-) strand; PAM type: YTN; PAM sequence: TTC
cccgtaagtttatcttcctt

SEQ ID NO: 12652 - DNA, 20 bp, Artificial Sequence
  Description of Artificial Sequence: Synthetic oligonucleotide
  Target: ANGPTL3; (-) strand; PAM type: YTN; PAM sequence: TTT
ccccgtaagtttatcttcct

SEQ ID NO: 12653 - DNA, 20 bp, Artificial Sequence
  Description of Artificial Sequence: Synthetic oligonucleotide
  Target: ANGPTL3; (-) strand; PAM type: YTN; PAM sequence: CTG
tatttccccgtaagtttatc

SEQ ID NO: 12654 - DNA, 20 bp, Artificial Sequence
  Description of Artificial Sequence: Synthetic oligonucleotide
  Target: ANGPTL3; (-) strand; PAM type: YTN; PAM sequence: TTA
ctgtatttccccgtaagttt

SEQ ID NO: 12655 - DNA, 20 bp, Artificial Sequence
  Description of Artificial Sequence: Synthetic oligonucleotide
  Target: ANGPTL3; (-) strand; PAM type: YTN; PAM sequence: CTG
ttactgtatttccccgtaag

SEQ ID NO: 12656 - DNA, 20 bp, Artificial Sequence
  Description of Artificial Sequence: Synthetic oligonucleotide
  Target: ANGPTL3; (-) strand; PAM type: YTN; PAM sequence: TTA
ctgttactgtatttccccgt

SEQ ID NO: 12657 - DNA, 20 bp, Artificial Sequence
  Description of Artificial Sequence: Synthetic oligonucleotide
  Target: ANGPTL3; (-) strand; PAM type: YTN; PAM sequence: CTC
gtatgtagttactgttactg

SEQ ID NO: 12658 - DNA, 20 bp, Artificial Sequence
  Description of Artificial Sequence: Synthetic oligonucleotide
  Target: ANGPTL3; (-) strand; PAM type: YTN; PAM sequence: TTA
atgggtacagactcgtatgt

SEQ ID NO: 12659 - DNA, 20 bp, Artificial Sequence
  Description of Artificial Sequence: Synthetic oligonucleotide
  Target: ANGPTL3; (-) strand; PAM type: YTN; PAM sequence: TTT
aatgggtacagactcgtatg

SEQ ID NO: 12660 - DNA, 20 bp, Artificial Sequence
  Description of Artificial Sequence: Synthetic oligonucleotide
  Target: ANGPTL3; (-) strand; PAM type: YTN; PAM sequence: CTA
aaggagatagatatgcaatt

SEQ ID NO: 12661 - DNA, 20 bp, Artificial Sequence
  Description of Artificial Sequence: Synthetic oligonucleotide
  Target: ANGPTL3; (-) strand; PAM type: YTN; PAM sequence: CTC
ctaaaggagatagatatgca

SEQ ID NO: 12662 - DNA, 20 bp, Artificial Sequence
  Description of Artificial Sequence: Synthetic oligonucleotide
  Target: ANGPTL3; (-) strand; PAM type: YTN; PAM sequence: CTC
atcatgccaccaccagcctc

SEQ ID NO: 12663 - DNA, 20 bp, Artificial Sequence
  Description of Artificial Sequence: Synthetic oligonucleotide
  Target: ANGPTL3; (-) strand; PAM type: YTN; PAM sequence: CTC
cacactcatcatgccaccac

SEQ ID NO: 12664 - DNA, 20 bp, Artificial Sequence
  Description of Artificial Sequence: Synthetic oligonucleotide
  Target: ANGPTL3; (-) strand; PAM type: YTN; PAM sequence: TTC
tccacactcatcatgccacc

SEQ ID NO: 12665 - DNA, 20 bp, Artificial Sequence
  Description of Artificial Sequence: Synthetic oligonucleotide
  Target: ANGPTL3; (-) strand; PAM type: YTN; PAM sequence: TTT
ctccacactcatcatgccac

SEQ ID NO: 12666 - DNA, 20 bp, Artificial Sequence
  Description of Artificial Sequence: Synthetic oligonucleotide
  Target: ANGPTL3; (-) strand; PAM type: YTN; PAM sequence: TTT
tctccacactcatcatgcca

SEQ ID NO: 12667 - DNA, 20 bp, Artificial Sequence
  Description of Artificial Sequence: Synthetic oligonucleotide
  Target: ANGPTL3; (-) strand; PAM type: YTN; PAM sequence: TTG
ttttctccacactcatcatg

SEQ ID NO: 12668 - DNA, 20 bp, Artificial Sequence
  Description of Artificial Sequence: Synthetic oligonucleotide
  Target: ANGPTL3; (-) strand; PAM type: YTN; PAM sequence: TTA
ggttgttttctccacactca

SEQ ID NO: 12669 - DNA, 20 bp, Artificial Sequence
  Description of Artificial Sequence: Synthetic oligonucleotide
  Target: ANGPTL3; (-) strand; PAM type: YTN; PAM sequence: TTT
aggttgttttctccacactc

SEQ ID NO: 12670 - DNA, 20 bp, Artificial Sequence
  Description of Artificial Sequence: Synthetic oligonucleotide
  Target: ANGPTL3; (-) strand; PAM type: YTN; PAM sequence: TTA
ccatttaggttgttttctcc

SEQ ID NO: 12671 - DNA, 20 bp, Artificial Sequence
  Description of Artificial Sequence: Synthetic oligonucleotide
  Target: ANGPTL3; (-) strand; PAM type: YTN; PAM sequence: TTT
accatttaggttgttttctc

SEQ ID NO: 12672 - DNA, 20 bp, Artificial Sequence
  Description of Artificial Sequence: Synthetic oligonucleotide
  Target: ANGPTL3; (-) strand; PAM type: YTN; PAM sequence: TTA
tatttaccatttaggttgtt

SEQ ID NO: 12673 - DNA, 20 bp, Artificial Sequence
  Description of Artificial Sequence: Synthetic oligonucleotide
  Target: ANGPTL3; (-) strand; PAM type: YTN; PAM sequence: TTG
ttatatttaccatttaggtt

SEQ ID NO: 12674 - DNA, 20 bp, Artificial Sequence
  Description of Artificial Sequence: Synthetic oligonucleotide
  Target: ANGPTL3; (-) strand; PAM type: YTN; PAM sequence: TTT
gttatatttaccatttaggt

SEQ ID NO: 12675 - DNA, 20 bp, Artificial Sequence
  Description of Artificial Sequence: Synthetic oligonucleotide
  Target: ANGPTL3; (-) strand; PAM type: YTN; PAM sequence: TTG
gtttgttatatttaccattt

SEQ ID NO: 12676 - DNA, 20 bp, Artificial Sequence
  Description of Artificial Sequence: Synthetic oligonucleotide
  Target: ANGPTL3; (-) strand; PAM type: YTN; PAM sequence: CTT
ggtttgttatatttaccatt

SEQ ID NO: 12677 - DNA, 20 bp, Artificial Sequence
  Description of Artificial Sequence: Synthetic oligonucleotide
  Target: ANGPTL3; (-) strand; PAM type: YTN; PAM sequence: CTC
ttggtttgttatatttacca

SEQ ID NO: 12678 - DNA, 20 bp, Artificial Sequence
  Description of Artificial Sequence: Synthetic oligonucleotide
  Target: ANGPTL3; (-) strand; PAM type: YTN; PAM sequence: TTG
ctcttggtttgttatattta

SEQ ID NO: 12679 - DNA, 20 bp, Artificial Sequence
  Description of Artificial Sequence: Synthetic oligonucleotide
  Target: ANGPTL3; (-) strand; PAM type: YTN; PAM sequence: TTT
gctcttggtttgttatattt

SEQ ID NO: 12680 - DNA, 20 bp, Artificial Sequence
  Description of Artificial Sequence: Synthetic oligonucleotide
  Target: ANGPTL3; (-) strand; PAM type: YTN; PAM sequence: TTT
tgctcttggtttgttatatt

SEQ ID NO: 12681 - DNA, 20 bp, Artificial Sequence
  Description of Artificial Sequence: Synthetic oligonucleotide
  Target: ANGPTL3; (-) strand; PAM type: YTN; PAM sequence: TTA
gattttgctcttggtttgtt

SEQ ID NO: 12682 - DNA, 20 bp, Artificial Sequence
  Description of Artificial Sequence: Synthetic oligonucleotide
  Target: ANGPTL3; (-) strand; PAM type: YTN; PAM sequence: CTT
agattttgctcttggtttgt

SEQ ID NO: 12683 - DNA, 20 bp, Artificial Sequence
  Description of Artificial Sequence: Synthetic oligonucleotide
  Target: ANGPTL3; (-) strand; PAM type: YTN; PAM sequence: CTG
gcttagattttgctcttggt

SEQ ID NO: 12684 - DNA, 20 bp, Artificial Sequence
  Description of Artificial Sequence: Synthetic oligonucleotide
  Target: ANGPTL3; (-) strand; PAM type: YTN; PAM sequence: CTC
tggcttagattttgctcttg

SEQ ID NO: 12685 - DNA, 20 bp, Artificial Sequence
  Description of Artificial Sequence: Synthetic oligonucleotide
  Target: ANGPTL3; (-) strand; PAM type: YTN; PAM sequence: CTC
tctggcttagattttgctct

SEQ ID NO: 12686 - DNA, 20 bp, Artificial Sequence
  Description of Artificial Sequence: Synthetic oligonucleotide
  Target: ANGPTL3; (-) strand; PAM type: YTN; PAM sequence: CTC
ctctctggcttagattttgc

SEQ ID NO: 12687 - DNA, 20 bp, Artificial Sequence
  Description of Artificial Sequence: Synthetic oligonucleotide
  Target: ANGPTL3; (-) strand; PAM type: YTN; PAM sequence: TTC
tcctctctggcttagatttt

SEQ ID NO: 12688 - DNA, 20 bp, Artificial Sequence
  Description of Artificial Sequence: Synthetic oligonucleotide
  Target: ANGPTL3; (-) strand; PAM type: YTN; PAM sequence: CTT
ctcctctctggcttagattt

SEQ ID NO: 12689 - DNA, 20 bp, Artificial Sequence
  Description of Artificial Sequence: Synthetic oligonucleotide
  Target: ANGPTL3; (-) strand; PAM type: YTN; PAM sequence: CTC
ttctcctctctggcttagat

SEQ ID NO: 12690 - DNA, 20 bp, Artificial Sequence
  Description of Artificial Sequence: Synthetic oligonucleotide
  Target: ANGPTL3; (-) strand; PAM type: YTN; PAM sequence: TTC
caagataatcctcttctcct

SEQ ID NO: 12691 - DNA, 20 bp, Artificial Sequence
  Description of Artificial Sequence: Synthetic oligonucleotide
  Target: ANGPTL3; (-) strand; PAM type: YTN; PAM sequence: CTT
ccaagataatcctcttctcc

SEQ ID NO: 12692 - DNA, 20 bp, Artificial Sequence
  Description of Artificial Sequence: Synthetic oligonucleotide
  Target: ANGPTL3; (-) strand; PAM type: YTN; PAM sequence: TTG
agacttccaagataatcctc

SEQ ID NO: 12693 - DNA, 20 bp, Artificial Sequence
  Description of Artificial Sequence: Synthetic oligonucleotide
  Target: ANGPTL3; (-) strand; PAM type: YTN; PAM sequence: TTT
gagacttccaagataatcct

SEQ ID NO: 12694 - DNA, 20 bp, Artificial Sequence
  Description of Artificial Sequence: Synthetic oligonucleotide
  Target: ANGPTL3; (-) strand; PAM type: YTN; PAM sequence: TTT
tgagacttccaagataatcc

SEQ ID NO: 12695 - DNA, 20 bp, Artificial Sequence
  Description of Artificial Sequence: Synthetic oligonucleotide
  Target: ANGPTL3; (-) strand; PAM type: YTN; PAM sequence: TTC
cattttgagacttccaagat

SEQ ID NO: 12696 - DNA, 20 bp, Artificial Sequence
  Description of Artificial Sequence: Synthetic oligonucleotide
  Target: ANGPTL3; (-) strand; PAM type: YTN; PAM sequence: CTT
ccattttgagacttccaaga

SEQ ID NO: 12697 - DNA, 20 bp, Artificial Sequence
  Description of Artificial Sequence: Synthetic oligonucleotide
  Target: ANGPTL3; (-) strand; PAM type: YTN; PAM sequence: TTA
tagagtataaccttccattt

SEQ ID NO: 12698 - DNA, 20 bp, Artificial Sequence
  Description of Artificial Sequence: Synthetic oligonucleotide
  Target: ANGPTL3; (-) strand; PAM type: YTN; PAM sequence: TTT
atagagtataaccttccatt

SEQ ID NO: 12699 - DNA, 20 bp, Artificial Sequence
  Description of Artificial Sequence: Synthetic oligonucleotide
  Target: ANGPTL3; (-) strand; PAM type: YTN; PAM sequence: TTT
tatagagtataaccttccat

SEQ ID NO: 12700 - DNA, 20 bp, Artificial Sequence
  Description of Artificial Sequence: Synthetic oligonucleotide
  Target: ANGPTL3; (-) strand; PAM type: YTN; PAM sequence: TTG
attttatagagtataacctt

SEQ ID NO: 12701 - DNA, 20 bp, Artificial Sequence
  Description of Artificial Sequence: Synthetic oligonucleotide
  Target: ANGPTL3; (-) strand; PAM type: YTN; PAM sequence: TTG
gttgattttatagagtataa

SEQ ID NO: 12702 - DNA, 20 bp, Artificial Sequence
  Description of Artificial Sequence: Synthetic oligonucleotide
  Target: ANGPTL3; (-) strand; PAM type: YTN; PAM sequence: TTT
ggttgattttatagagtata

SEQ ID NO: 12703 - DNA, 20 bp, Artificial Sequence
  Description of Artificial Sequence: Synthetic oligonucleotide
  Target: ANGPTL3; (-) strand; PAM type: YTN; PAM sequence: TTT
tggttgattttatagagtat

SEQ ID NO: 12704 - DNA, 20 bp, Artificial Sequence
  Description of Artificial Sequence: Synthetic oligonucleotide
  Target: ANGPTL3; (-) strand; PAM type: YTN; PAM sequence: TTG
gatggatcaacattttggtt

SEQ ID NO: 12705 - DNA, 20 bp, Artificial Sequence
  Description of Artificial Sequence: Synthetic oligonucleotide
  Target: ANGPTL3; (-) strand; PAM type: YTN; PAM sequence: CTG
ttggatggatcaacattttg

SEQ ID NO: 12706 - DNA, 20 bp, Artificial Sequence
  Description of Artificial Sequence: Synthetic oligonucleotide
  Target: ANGPTL3; (-) strand; PAM type: YTN; PAM sequence: CTG
aatctgttggatggatcaac

SEQ ID NO: 12707 - DNA, 20 bp, Artificial Sequence
  Description of Artificial Sequence: Synthetic oligonucleotide
  Target: ANGPTL3; (-) strand; PAM type: YTN; PAM sequence: TTC
tgaatctgttggatggatca

SEQ ID NO: 12708 - DNA, 20 bp, Artificial Sequence
  Description of Artificial Sequence: Synthetic oligonucleotide
  Target: ANGPTL3; (-) strand; PAM type: YTN; PAM sequence: TTT
ctgaatctgttggatggatc

SEQ ID NO: 12709 - DNA, 20 bp, Artificial Sequence
  Description of Artificial Sequence: Synthetic oligonucleotide
  Target: ANGPTL3; (-) strand; PAM type: YTN; PAM sequence: CTT
tctgaatctgttggatggat

SEQ ID NO: 12710 - DNA, 20 bp, Artificial Sequence
  Description of Artificial Sequence: Synthetic oligonucleotide
  Target: ANGPTL3; (-) strand; PAM type: YTN; PAM sequence: TTC
aaagctttctgaatctgttg

SEQ ID NO: 12711 - DNA, 20 bp, Artificial Sequence
  Description of Artificial Sequence: Synthetic oligonucleotide
  Target: ANGPTL3; (-) strand; PAM type: YTN; PAM sequence: TTC
attcaaagctttctgaatct

SEQ ID NO: 12712 - DNA, 20 bp, Artificial Sequence
  Description of Artificial Sequence: Synthetic oligonucleotide
  Target: ANGPTL3; (-) strand; PAM type: YTN; PAM sequence: CTC
agttcattcaaagctttctg

SEQ ID NO: 12713 - DNA, 20 bp, Artificial Sequence
  Description of Artificial Sequence: Synthetic oligonucleotide
  Target: ANGPTL3; (-) strand; PAM type: YTN; PAM sequence: TTG
cctcagttcattcaaagctt

SEQ ID NO: 12714 - DNA, 20 bp, Artificial Sequence
  Description of Artificial Sequence: Synthetic oligonucleotide
  Target: ANGPTL3; (-) strand; PAM type: YTN; PAM sequence: TTT
gcctcagttcattcaaagct

SEQ ID NO: 12715 - DNA, 20 bp, Artificial Sequence
  Description of Artificial Sequence: Synthetic oligonucleotide
  Target: ANGPTL3; (-) strand; PAM type: YTN; PAM sequence: TTA
aatttgcctcagttcattca

SEQ ID NO: 12716 - DNA, 20 bp, Artificial Sequence
  Description of Artificial Sequence: Synthetic oligonucleotide
  Target: ANGPTL3; (-) strand; PAM type: YTN; PAM sequence: TTT
aaatttgcctcagttcattc

SEQ ID NO: 12717 - DNA, 20 bp, Artificial Sequence
  Description of Artificial Sequence: Synthetic oligonucleotide
  Target: ANGPTL3; (-) strand; PAM type: YTN; PAM sequence: TTT
taaatttgcctcagttcatt

SEQ ID NO: 12718 - DNA, 20 bp, Artificial Sequence
  Description of Artificial Sequence: Synthetic oligonucleotide
  Target: ANGPTL3; (-) strand; PAM type: YTN; PAM sequence: CTT
ttaaatttgcctcagttcat

SEQ ID NO: 12719 - DNA, 20 bp, Artificial Sequence
  Description of Artificial Sequence: Synthetic oligonucleotide
  Target: ANGPTL3; (-) strand; PAM type: YTN; PAM sequence: TTG
ccttttaaatttgcctcagt

SEQ ID NO: 12720 - DNA, 20 bp, Artificial Sequence
  Description of Artificial Sequence: Synthetic oligonucleotide
  Target: ANGPTL3; (-) strand; PAM type: YTN; PAM sequence: TTA
ttgccttttaaatttgcctc

SEQ ID NO: 12721 - DNA, 20 bp, Artificial Sequence
  Description of Artificial Sequence: Synthetic oligonucleotide
  Target: ANGPTL3; (-) strand; PAM type: YTN; PAM sequence: TTA
aattattgccttttaaattt

SEQ ID NO: 12722 - DNA, 20 bp, Artificial Sequence
  Description of Artificial Sequence: Synthetic oligonucleotide
  Target: ANGPTL3; (-) strand; PAM type: YTN; PAM sequence: TTT
aaattattgccttttaaatt

SEQ ID NO: 12723 - DNA, 20 bp, Artificial Sequence
  Description of Artificial Sequence: Synthetic oligonucleotide
  Target: ANGPTL3; (-) strand; PAM type: YTN; PAM sequence: TTA
atgtttaaattattgccttt

SEQ ID NO: 12724 - DNA, 20 bp, Artificial Sequence
  Description of Artificial Sequence: Synthetic oligonucleotide
  Target: ANGPTL3; (-) strand; PAM type: YTN; PAM sequence: TTG
gaatgaggttaatgtttaaa

SEQ ID NO: 12725 - DNA, 20 bp, Artificial Sequence
  Description of Artificial Sequence: Synthetic oligonucleotide
  Target: ANGPTL3; (-) strand; PAM type: YTN; PAM sequence: CTT
ggaatgaggttaatgtttaa

SEQ ID NO: 12726 - DNA, 20 bp, Artificial Sequence
  Description of Artificial Sequence: Synthetic oligonucleotide
  Target: ANGPTL3; (-) strand; PAM type: YTN; PAM sequence: TTA
acttggaatgaggttaatgt

SEQ ID NO: 12727 - DNA, 20 bp, Artificial Sequence
  Description of Artificial Sequence: Synthetic oligonucleotide
  Target: ANGPTL3; (-) strand; PAM type: YTN; PAM sequence: TTA
gaccacattaacttggaatg

SEQ ID NO: 12728 - DNA, 20 bp, Artificial Sequence
  Description of Artificial Sequence: Synthetic oligonucleotide
  Target: ANGPTL3; (-) strand; PAM type: YTN; PAM sequence: TTA
ttagaccacattaacttgga

SEQ ID NO: 12729 - DNA, 20 bp, Artificial Sequence
  Description of Artificial Sequence: Synthetic oligonucleotide
  Target: ANGPTL3; (-) strand; PAM type: YTN; PAM sequence: TTA
ataccagattattagaccac

SEQ ID NO: 12730 - DNA, 20 bp, Artificial Sequence
  Description of Artificial Sequence: Synthetic oligonucleotide
  Target: ANGPTL3; (-) strand; PAM type: YTN; PAM sequence: TTT
aataccagattattagacca

SEQ ID NO: 12731 - DNA, 20 bp, Artificial Sequence
  Description of Artificial Sequence: Synthetic oligonucleotide
  Target: ANGPTL3; (-) strand; PAM type: YTN; PAM sequence: TTA
aggatttaataccagattat

SEQ ID NO: 12732 - DNA, 20 bp, Artificial Sequence
  Description of Artificial Sequence: Synthetic oligonucleotide
  Target: ANGPTL3; (-) strand; PAM type: YTN; PAM sequence: CTT
aaggatttaataccagatta

SEQ ID NO: 12733 - DNA, 20 bp, Artificial Sequence
  Description of Artificial Sequence: Synthetic oligonucleotide
  Target: ANGPTL3; (-) strand; PAM type: YTN; PAM sequence: CTC
ttaaggatttaataccagat

SEQ ID NO: 12734 - DNA, 20 bp, Artificial Sequence
  Description of Artificial Sequence: Synthetic oligonucleotide
  Target: ANGPTL3; (-) strand; PAM type: YTN; PAM sequence: TTC
tcttaaggatttaataccag

SEQ ID NO: 12735 - DNA, 20 bp, Artificial Sequence
  Description of Artificial Sequence: Synthetic oligonucleotide
  Target: ANGPTL3; (-) strand; PAM type: YTN; PAM sequence: TTT
ctcttaaggatttaatacca

SEQ ID NO: 12736 - DNA, 20 bp, Artificial Sequence
  Description of Artificial Sequence: Synthetic oligonucleotide
  Target: ANGPTL3; (-) strand; PAM type: YTN; PAM sequence: CTT
tctcttaaggatttaatacc

SEQ ID NO: 12737 - DNA, 20 bp, Artificial Sequence
  Description of Artificial Sequence: Synthetic oligonucleotide
  Target: ANGPTL3; (-) strand; PAM type: YTN; PAM sequence: CTC
aagctttctcttaaggattt

SEQ ID NO: 12738 - DNA, 20 bp, Artificial Sequence
  Description of Artificial Sequence: Synthetic oligonucleotide
  Target: ANGPTL3; (-) strand; PAM type: YTN; PAM sequence: TTC
tcaagctttctcttaaggat

SEQ ID NO: 12739 - DNA, 20 bp, Artificial Sequence
  Description of Artificial Sequence: Synthetic oligonucleotide
  Target: ANGPTL3; (-) strand; PAM type: YTN; PAM sequence: TTT
ctcaagctttctcttaagga

SEQ ID NO: 12740 - DNA, 20 bp, Artificial Sequence
  Description of Artificial Sequence: Synthetic oligonucleotide
  Target: ANGPTL3; (-) strand; PAM type: YTN; PAM sequence: CTA
tttctcaagctttctcttaa

SEQ ID NO: 12741 - DNA, 20 bp, Artificial Sequence
  Description of Artificial Sequence: Synthetic oligonucleotide
  Target: ANGPTL3; (-) strand; PAM type: YTN; PAM sequence: TTA
agataaaaaaaatctatttc

SEQ ID NO: 12742 - DNA, 20 bp, Artificial Sequence
  Description of Artificial Sequence: Synthetic oligonucleotide
  Target: ANGPTL3; (-) strand; PAM type: YTN; PAM sequence: TTT
aagataaaaaaaatctattt

SEQ ID NO: 12743 - DNA, 20 bp, Artificial Sequence
  Description of Artificial Sequence: Synthetic oligonucleotide
  Target: ANGPTL3; (-) strand; PAM type: YTN; PAM sequence: CTT
taagataaaaaaaatctatt

SEQ ID NO: 12744 - DNA, 20 bp, Artificial Sequence
  Description of Artificial Sequence: Synthetic oligonucleotide
  Target: ANGPTL3; (-) strand; PAM type: YTN; PAM sequence: TTA
aatagacagtgactttaaga

SEQ ID NO: 12745 - DNA, 20 bp, Artificial Sequence
  Description of Artificial Sequence: Synthetic oligonucleotide
  Target: ANGPTL3; (-) strand; PAM type: YTN; PAM sequence: CTT
aaatagacagtgactttaag

SEQ ID NO: 12746 - DNA, 20 bp, Artificial Sequence
  Description of Artificial Sequence: Synthetic oligonucleotide
  Target: ANGPTL3; (-) strand; PAM type: YTN; PAM sequence: TTA
atcttaaatagacagtgact

SEQ ID NO: 12747 - DNA, 20 bp, Artificial Sequence
  Description of Artificial Sequence: Synthetic oligonucleotide
  Target: ANGPTL3; (-) strand; PAM type: YTN; PAM sequence: TTT
aatcttaaatagacagtgac

SEQ ID NO: 12748 - DNA, 20 bp, Artificial Sequence
  Description of Artificial Sequence: Synthetic oligonucleotide
  Target: ANGPTL3; (-) strand; PAM type: YTN; PAM sequence: TTG
tatgtttaatcttaaataga

SEQ ID NO: 12749 - DNA, 20 bp, Artificial Sequence
  Description of Artificial Sequence: Synthetic oligonucleotide
  Target: ANGPTL3; (-) strand; PAM type: YTN; PAM sequence: TTA
tgtgattgtatgtttaatct

SEQ ID NO: 12750 - DNA, 20 bp, Artificial Sequence
  Description of Artificial Sequence: Synthetic oligonucleotide
  Target: ANGPTL3; (-) strand; PAM type: YTN; PAM sequence: TTA
aggttatgtgattgtatgtt

SEQ ID NO: 12751 - DNA, 20 bp, Artificial Sequence
  Description of Artificial Sequence: Synthetic oligonucleotide
  Target: ANGPTL3; (-) strand; PAM type: YTN; PAM sequence: TTT
aaggttatgtgattgtatgt

SEQ ID NO: 12752 - DNA, 20 bp, Artificial Sequence
  Description of Artificial Sequence: Synthetic oligonucleotide
  Target: ANGPTL3; (-) strand; PAM type: YTN; PAM sequence: CTT
taaggttatgtgattgtatg

SEQ ID NO: 12753 - DNA, 20 bp, Artificial Sequence
  Description of Artificial Sequence: Synthetic oligonucleotide
  Target: ANGPTL3; (-) strand; PAM type: YTN; PAM sequence: TTC
tttaaggttatgtgattgta

SEQ ID NO: 12754 - DNA, 20 bp, Artificial Sequence
  Description of Artificial Sequence: Synthetic oligonucleotide
  Target: ANGPTL3; (-) strand; PAM type: YTN; PAM sequence: TTG
agaaatgtaaacggtattct

SEQ ID NO: 12755 - DNA, 20 bp, Artificial Sequence
  Description of Artificial Sequence: Synthetic oligonucleotide
  Target: ANGPTL3; (-) strand; PAM type: YTN; PAM sequence: TTG
attgagaaatgtaaacggta

SEQ ID NO: 12756 - DNA, 20 bp, Artificial Sequence
  Description of Artificial Sequence: Synthetic oligonucleotide
  Target: ANGPTL3; (-) strand; PAM type: YTN; PAM sequence: TTT
gattgagaaatgtaaacggt

SEQ ID NO: 12757 - DNA, 20 bp, Artificial Sequence
  Description of Artificial Sequence: Synthetic oligonucleotide
  Target: ANGPTL3; (-) strand; PAM type: YTN; PAM sequence: TTT
tgattgagaaatgtaaacgg

SEQ ID NO: 12758 - DNA, 20 bp, Artificial Sequence
  Description of Artificial Sequence: Synthetic oligonucleotide
  Target: ANGPTL3; (-) strand; PAM type: YTN; PAM sequence: TTA
taagaattttgattgagaaa

SEQ ID NO: 12759 - DNA, 20 bp, Artificial Sequence
  Description of Artificial Sequence: Synthetic oligonucleotide
  Target: ANGPTL3; (-) strand; PAM type: YTN; PAM sequence: TTA
aaacaaatagtattataaga

SEQ ID NO: 12760 - DNA, 20 bp, Artificial Sequence
  Description of Artificial Sequence: Synthetic oligonucleotide
  Target: ANGPTL3; (-) strand; PAM type: YTN; PAM sequence: TTT
aaaacaaatagtattataag

SEQ ID NO: 12761 - DNA, 20 bp, Artificial Sequence
  Description of Artificial Sequence: Synthetic oligonucleotide
  Target: ANGPTL3; (-) strand; PAM type: YTN; PAM sequence: TTC
ccacatcacaaaatttaaaa

SEQ ID NO: 12762 - DNA, 20 bp, Artificial Sequence
  Description of Artificial Sequence: Synthetic oligonucleotide
  Target: ANGPTL3; (-) strand; PAM type: YTN; PAM sequence: TTG
attcccacatcacaaaattt

SEQ ID NO: 12763 - DNA, 20 bp, Artificial Sequence
  Description of Artificial Sequence: Synthetic oligonucleotide
  Target: ANGPTL3; (-) strand; PAM type: YTN; PAM sequence: CTA
aaattgattcccacatcaca

SEQ ID NO: 12764 - DNA, 20 bp, Artificial Sequence
  Description of Artificial Sequence: Synthetic oligonucleotide
  Target: ANGPTL3; (-) strand; PAM type: YTN; PAM sequence: TTG
tgaccatctaaaattgattc

SEQ ID NO: 12765 - DNA, 20 bp, Artificial Sequence
  Description of Artificial Sequence: Synthetic oligonucleotide
  Target: ANGPTL3; (-) strand; PAM type: YTN; PAM sequence: CTA
gattgtgaccatctaaaatt

SEQ ID NO: 12766 - DNA, 20 bp, Artificial Sequence
  Description of Artificial Sequence: Synthetic oligonucleotide
  Target: ANGPTL3; (-) strand; PAM type: YTN; PAM sequence: TTA
taatctagattgtgaccatc

SEQ ID NO: 12767 - DNA, 20 bp, Artificial Sequence
  Description of Artificial Sequence: Synthetic oligonucleotide
  Target: ANGPTL3; (-) strand; PAM type: YTN; PAM sequence: TTG
attataatctagattgtgac

SEQ ID NO: 12768 - DNA, 20 bp, Artificial Sequence
  Description of Artificial Sequence: Synthetic oligonucleotide
  Target: ANGPTL3; (-) strand; PAM type: YTN; PAM sequence: CTA
ttgattataatctagattgt

SEQ ID NO: 12769 - DNA, 20 bp, Artificial Sequence
  Description of Artificial Sequence: Synthetic oligonucleotide
  Target: ANGPTL3; (-) strand; PAM type: YTN; PAM sequence: TTC
acctattgattataatctag

SEQ ID NO: 12770 - DNA, 20 bp, Artificial Sequence
  Description of Artificial Sequence: Synthetic oligonucleotide
  Target: ANGPTL3; (-) strand; PAM type: YTN; PAM sequence: TTA
ataagttcacctattgatta

SEQ ID NO: 12771 - DNA, 20 bp, Artificial Sequence
  Description of Artificial Sequence: Synthetic oligonucleotide
  Target: ANGPTL3; (-) strand; PAM type: YTN; PAM sequence: TTT
aataagttcacctattgatt

SEQ ID NO: 12772 - DNA, 20 bp, Artificial Sequence
  Description of Artificial Sequence: Synthetic oligonucleotide
  Target: ANGPTL3; (-) strand; PAM type: YTN; PAM sequence: TTA
tttaataagttcacctattg

SEQ ID NO: 12773 - DNA, 20 bp, Artificial Sequence
  Description of Artificial Sequence: Synthetic oligonucleotide
  Target: ANGPTL3; (-) strand; PAM type: YTN; PAM sequence: TTA
gaaaagttatttaataagtt

SEQ ID NO: 12774 - DNA, 20 bp, Artificial Sequence
  Description of Artificial Sequence: Synthetic oligonucleotide
  Target: ANGPTL3; (-) strand; PAM type: YTN; PAM sequence: TTT
agaaaagttatttaataagt

SEQ ID NO: 12775 - DNA, 20 bp, Artificial Sequence
  Description of Artificial Sequence: Synthetic oligonucleotide
  Target: ANGPTL3; (-) strand; PAM type: YTN; PAM sequence: TTA
tttagaaaagttatttaata

SEQ ID NO: 12776 - DNA, 20 bp, Artificial Sequence
  Description of Artificial Sequence: Synthetic oligonucleotide
  Target: ANGPTL3; (-) strand; PAM type: YTN; PAM sequence: TTT
atttagaaaagttatttaat

SEQ ID NO: 12777 - DNA, 20 bp, Artificial Sequence
  Description of Artificial Sequence: Synthetic oligonucleotide
  Target: ANGPTL3; (-) strand; PAM type: YTN; PAM sequence: TTT
tatttagaaaagttatttaa

SEQ ID NO: 12778 - DNA, 20 bp, Artificial Sequence
  Description of Artificial Sequence: Synthetic oligonucleotide
  Target: ANGPTL3; (-) strand; PAM type: YTN; PAM sequence: TTT
ttatttagaaaagttattta

SEQ ID NO: 12779 - DNA, 20 bp, Artificial Sequence
  Description of Artificial Sequence: Synthetic oligonucleotide
  Target: ANGPTL3; (-) strand; PAM type: YTN; PAM sequence: TTT
tttatttagaaaagttattt

SEQ ID NO: 12780 - DNA, 20 bp, Artificial Sequence
  Description of Artificial Sequence: Synthetic oligonucleotide
  Target: ANGPTL3; (-) strand; PAM type: YTN; PAM sequence: CTA
aattttttatttagaaaagt

SEQ ID NO: 12781 - DNA, 20 bp, Artificial Sequence
  Description of Artificial Sequence: Synthetic oligonucleotide
  Target: ANGPTL3; (-) strand; PAM type: YTN; PAM sequence: CTC
taaattttttatttagaaaa

SEQ ID NO: 12782 - DNA, 20 bp, Artificial Sequence
  Description of Artificial Sequence: Synthetic oligonucleotide
  Target: ANGPTL3; (-) strand; PAM type: YTN; PAM sequence: TTA
aaataaaagtctctaaattt

SEQ ID NO: 12783 - DNA, 20 bp, Artificial Sequence
  Description of Artificial Sequence: Synthetic oligonucleotide
  Target: ANGPTL3; (-) strand; PAM type: YTN; PAM sequence: TTT
aaaataaaagtctctaaatt

SEQ ID NO: 12784 - DNA, 20 bp, Artificial Sequence
  Description of Artificial Sequence: Synthetic oligonucleotide
  Target: ANGPTL3; (-) strand; PAM type: YTN; PAM sequence: TTT
taaaataaaagtctctaaat

SEQ ID NO: 12785 - DNA, 20 bp, Artificial Sequence
  Description of Artificial Sequence: Synthetic oligonucleotide
  Target: ANGPTL3; (-) strand; PAM type: YTN; PAM sequence: CTT
ttaaaataaaagtctctaaa

SEQ ID NO: 12786 - DNA, 20 bp, Artificial Sequence
  Description of Artificial Sequence: Synthetic oligonucleotide
  Target: ANGPTL3; (-) strand; PAM type: YTN; PAM sequence: CTC
atatgatgccttttaaaata

SEQ ID NO: 12787 - DNA, 20 bp, Artificial Sequence
  Description of Artificial Sequence: Synthetic oligonucleotide
  Target: ANGPTL3; (-) strand; PAM type: YTN; PAM sequence: TTA
gctcatatgatgccttttaa

SEQ ID NO: 12788 - DNA, 20 bp, Artificial Sequence
  Description of Artificial Sequence: Synthetic oligonucleotide
  Target: ANGPTL3; (-) strand; PAM type: YTN; PAM sequence: TTG
tgatattagctcatatgatg

SEQ ID NO: 12789 - DNA, 20 bp, Artificial Sequence
  Description of Artificial Sequence: Synthetic oligonucleotide
  Target: ANGPTL3; (-) strand; PAM type: YTN; PAM sequence: CTG
ggaaagttgtgatattagct

SEQ ID NO: 12790 - DNA, 20 bp, Artificial Sequence
  Description of Artificial Sequence: Synthetic oligonucleotide
  Target: ANGPTL3; (-) strand; PAM type: YTN; PAM sequence: TTA
aactgggaaagttgtgatat

SEQ ID NO: 12791 - DNA, 20 bp, Artificial Sequence
  Description of Artificial Sequence: Synthetic oligonucleotide
  Target: ANGPTL3; (-) strand; PAM type: YTN; PAM sequence: TTT
aaactgggaaagttgtgata

SEQ ID NO: 12792 - DNA, 20 bp, Artificial Sequence
  Description of Artificial Sequence: Synthetic oligonucleotide
  Target: ANGPTL3; (-) strand; PAM type: YTN; PAM sequence: TTT
taaactgggaaagttgtgat

SEQ ID NO: 12793 - DNA, 20 bp, Artificial Sequence
  Description of Artificial Sequence: Synthetic oligonucleotide
  Target: ANGPTL3; (-) strand; PAM type: YTN; PAM sequence: TTT
ttaaactgggaaagttgtga

SEQ ID NO: 12794 - DNA, 20 bp, Artificial Sequence
  Description of Artificial Sequence: Synthetic oligonucleotide
  Target: ANGPTL3; (-) strand; PAM type: YTN; PAM sequence: TTT
tttaaactgggaaagttgtg

SEQ ID NO: 12795 - DNA, 20 bp, Artificial Sequence
  Description of Artificial Sequence: Synthetic oligonucleotide
  Target: ANGPTL3; (-) strand; PAM type: YTN; PAM sequence: CTA
gttttttaaactgggaaagt

SEQ ID NO: 12796 - DNA, 20 bp, Artificial Sequence
  Description of Artificial Sequence: Synthetic oligonucleotide
  Target: ANGPTL3; (-) strand; PAM type: YTN; PAM sequence: TTA
acaagagtactagtttttta

SEQ ID NO: 12797 - DNA, 20 bp, Artificial Sequence
  Description of Artificial Sequence: Synthetic oligonucleotide
  Target: ANGPTL3; (-) strand; PAM type: YTN; PAM sequence: TTT
aacaagagtactagtttttt

SEQ ID NO: 12798 - DNA, 20 bp, Artificial Sequence
  Description of Artificial Sequence: Synthetic oligonucleotide
  Target: ANGPTL3; (-) strand; PAM type: YTN; PAM sequence: TTT
taacaagagtactagttttt

SEQ ID NO: 12799 - DNA, 20 bp, Artificial Sequence
  Description of Artificial Sequence: Synthetic oligonucleotide
  Target: ANGPTL3; (-) strand; PAM type: YTN; PAM sequence: TTA
gagttttaacaagagtacta

SEQ ID NO: 12800 - DNA, 20 bp, Artificial Sequence
  Description of Artificial Sequence: Synthetic oligonucleotide
  Target: ANGPTL3; (-) strand; PAM type: YTN; PAM sequence: TTT
agagttttaacaagagtact

SEQ ID NO: 12801 - DNA, 20 bp, Artificial Sequence
  Description of Artificial Sequence: Synthetic oligonucleotide
  Target: ANGPTL3; (-) strand; PAM type: YTN; PAM sequence: TTA
gtcaagtttagagttttaac

SEQ ID NO: 12802 - DNA, 20 bp, Artificial Sequence
  Description of Artificial Sequence: Synthetic oligonucleotide
  Target: ANGPTL3; (-) strand; PAM type: YTN; PAM sequence: TTT
agtcaagtttagagttttaa

SEQ ID NO: 12803 - DNA, 20 bp, Artificial Sequence
  Description of Artificial Sequence: Synthetic oligonucleotide
  Target: ANGPTL3; (-) strand; PAM type: YTN; PAM sequence: CTG
tatttagtcaagtttagagt

SEQ ID NO: 12804 - DNA, 20 bp, Artificial Sequence
  Description of Artificial Sequence: Synthetic oligonucleotide
  Target: ANGPTL3; (-) strand; PAM type: YTN; PAM sequence: CTC
tgtatttagtcaagtttaga

SEQ ID NO: 12805 - DNA, 20 bp, Artificial Sequence
  Description of Artificial Sequence: Synthetic oligonucleotide
  Target: ANGPTL3; (-) strand; PAM type: YTN; PAM sequence: TTA
ccagtcctctgtatttagtc

SEQ ID NO: 12806 - DNA, 20 bp, Artificial Sequence
  Description of Artificial Sequence: Synthetic oligonucleotide
  Target: ANGPTL3; (-) strand; PAM type: YTN; PAM sequence: CTG
tacaattaccagtcctctgt

SEQ ID NO: 12807 - DNA, 20 bp, Artificial Sequence
  Description of Artificial Sequence: Synthetic oligonucleotide
  Target: ANGPTL3; (-) strand; PAM type: YTN; PAM sequence: TTA
agaactgtacaattaccagt

SEQ ID NO: 12808 - DNA, 20 bp, Artificial Sequence
  Description of Artificial Sequence: Synthetic oligonucleotide
  Target: ANGPTL3; (-) strand; PAM type: YTN; PAM sequence: TTT
aagaactgtacaattaccag

SEQ ID NO: 12809 - DNA, 20 bp, Artificial Sequence
  Description of Artificial Sequence: Synthetic oligonucleotide
  Target: ANGPTL3; (-) strand; PAM type: YTN; PAM sequence: CTA
caacatttaagaactgtaca

SEQ ID NO: 12810 - DNA, 20 bp, Artificial Sequence
  Description of Artificial Sequence: Synthetic oligonucleotide
  Target: ANGPTL3; (-) strand; PAM type: YTN; PAM sequence: TTA
atactacaacatttaagaac

SEQ ID NO: 12811 - DNA, 20 bp, Artificial Sequence
  Description of Artificial Sequence: Synthetic oligonucleotide
  Target: ANGPTL3; (-) strand; PAM type: YTN; PAM sequence: TTG
aaattaatactacaacattt

SEQ ID NO: 12812 - DNA, 20 bp, Artificial Sequence
  Description of Artificial Sequence: Synthetic oligonucleotide
  Target: ANGPTL3; (-) strand; PAM type: YTN; PAM sequence: TTT
gaaattaatactacaacatt

SEQ ID NO: 12813 - DNA, 20 bp, Artificial Sequence
  Description of Artificial Sequence: Synthetic oligonucleotide
  Target: ANGPTL3; (-) strand; PAM type: YTN; PAM sequence: TTT
tgaaattaatactacaacat

SEQ ID NO: 12814 - DNA, 20 bp, Artificial Sequence
  Description of Artificial Sequence: Synthetic oligonucleotide
  Target: ANGPTL3; (-) strand; PAM type: YTN; PAM sequence: TTA
gttttgaaattaatactaca

SEQ ID NO: 12815 - DNA, 20 bp, Artificial Sequence
  Description of Artificial Sequence: Synthetic oligonucleotide
  Target: ANGPTL3; (-) strand; PAM type: YTN; PAM sequence: TTT
agttttgaaattaatactac

SEQ ID NO: 12816 - DNA, 20 bp, Artificial Sequence
  Description of Artificial Sequence: Synthetic oligonucleotide
  Target: ANGPTL3; (-) strand; PAM type: YTN; PAM sequence: TTT
tagttttgaaattaatacta

SEQ ID NO: 12817 - DNA, 20 bp, Artificial Sequence
  Description of Artificial Sequence: Synthetic oligonucleotide
  Target: ANGPTL3; (-) strand; PAM type: YTN; PAM sequence: TTT
ttagttttgaaattaatact

SEQ ID NO: 12818 - DNA, 20 bp, Artificial Sequence
  Description of Artificial Sequence: Synthetic oligonucleotide
  Target: ANGPTL3; (-) strand; PAM type: YTN; PAM sequence: CTG
acgatttttagttttgaaat

SEQ ID NO: 12819 - DNA, 20 bp, Artificial Sequence
  Description of Artificial Sequence: Synthetic oligonucleotide
  Target: ANGPTL3; (-) strand; PAM type: YTN; PAM sequence: CTG
tgctgacgatttttagtttt

SEQ ID NO: 12820 - DNA, 20 bp, Artificial Sequence
  Description of Artificial Sequence: Synthetic oligonucleotide
  Target: ANGPTL3; (-) strand; PAM type: YTN; PAM sequence: CTC
tgtgctgacgatttttagtt

SEQ ID NO: 12821 - DNA, 20 bp, Artificial Sequence
  Description of Artificial Sequence: Synthetic oligonucleotide
  Target: ANGPTL3; (-) strand; PAM type: YTN; PAM sequence: TTA
cacatactctgtgctgacga

SEQ ID NO: 12822 - DNA, 20 bp, Artificial Sequence
  Description of Artificial Sequence: Synthetic oligonucleotide
  Target: ANGPTL3; (-) strand; PAM type: YTN; PAM sequence: TTT
acacatactctgtgctgacg

SEQ ID NO: 12823 - DNA, 20 bp, Artificial Sequence
  Description of Artificial Sequence: Synthetic oligonucleotide
  Target: ANGPTL3; (-) strand; PAM type: YTN; PAM sequence: TTT
tacacatactctgtgctgac

SEQ ID NO: 12824 - DNA, 20 bp, Artificial Sequence
  Description of Artificial Sequence: Synthetic oligonucleotide
  Target: ANGPTL3; (-) strand; PAM type: YTN; PAM sequence: TTT
ttacacatactctgtgctga

SEQ ID NO: 12825 - DNA, 20 bp, Artificial Sequence
  Description of Artificial Sequence: Synthetic oligonucleotide
  Target: ANGPTL3; (-) strand; PAM type: YTN; PAM sequence: TTA
cagatttttacacatactct

SEQ ID NO: 12826 - DNA, 20 bp, Artificial Sequence
  Description of Artificial Sequence: Synthetic oligonucleotide
  Target: ANGPTL3; (-) strand; PAM type: YTN; PAM sequence: TTG
tattacagatttttacacat

SEQ ID NO: 12827 - DNA, 20 bp, Artificial Sequence
  Description of Artificial Sequence: Synthetic oligonucleotide
  Target: ANGPTL3; (-) strand; PAM type: YTN; PAM sequence: TTT
gtattacagatttttacaca

SEQ ID NO: 12828 - DNA, 20 bp, Artificial Sequence
  Description of Artificial Sequence: Synthetic oligonucleotide
  Target: ANGPTL3; (-) strand; PAM type: YTN; PAM sequence: TTA
aaaatttgtattacagattt

SEQ ID NO: 12829 - DNA, 20 bp, Artificial Sequence
  Description of Artificial Sequence: Synthetic oligonucleotide
  Target: ANGPTL3; (-) strand; PAM type: YTN; PAM sequence: TTT
aaaaatttgtattacagatt

SEQ ID NO: 12830 - DNA, 20 bp, Artificial Sequence
  Description of Artificial Sequence: Synthetic oligonucleotide
  Target: ANGPTL3; (-) strand; PAM type: YTN; PAM sequence: TTG
tagcaaaatgaagcatcagt

SEQ ID NO: 12831 - DNA, 20 bp, Artificial Sequence
  Description of Artificial Sequence: Synthetic oligonucleotide
  Target: ANGPTL3; (-) strand; PAM type: YTN; PAM sequence: TTT
gtagcaaaatgaagcatcag

SEQ ID NO: 12832 - DNA, 20 bp, Artificial Sequence
  Description of Artificial Sequence: Synthetic oligonucleotide
  Target: ANGPTL3; (-) strand; PAM type: YTN; PAM sequence: TTT
tgtagcaaaatgaagcatca

SEQ ID NO: 12833 - DNA, 20 bp, Artificial Sequence
  Description of Artificial Sequence: Synthetic oligonucleotide
  Target: ANGPTL3; (-) strand; PAM type: YTN; PAM sequence: TTA
ttttgtagcaaaatgaagca

SEQ ID NO: 12834 - DNA, 20 bp, Artificial Sequence
  Description of Artificial Sequence: Synthetic oligonucleotide
  Target: ANGPTL3; (-) strand; PAM type: YTN; PAM sequence: CTC
caaattattttgtagcaaaa

SEQ ID NO: 12835 - DNA, 20 bp, Artificial Sequence
  Description of Artificial Sequence: Synthetic oligonucleotide
  Target: ANGPTL3; (-) strand; PAM type: YTN; PAM sequence: TTA
ctccaaattattttgtagca

SEQ ID NO: 12836 - DNA, 20 bp, Artificial Sequence
  Description of Artificial Sequence: Synthetic oligonucleotide
  Target: ANGPTL3; (-) strand; PAM type: YTN; PAM sequence: TTT
actccaaattattttgtagc

SEQ ID NO: 12837 - DNA, 20 bp, Artificial Sequence
  Description of Artificial Sequence: Synthetic oligonucleotide
  Target: ANGPTL3; (-) strand; PAM type: YTN; PAM sequence: TTC
ataaataaatcatatcaaac

SEQ ID NO: 12838 - DNA, 20 bp, Artificial Sequence
  Description of Artificial Sequence: Synthetic oligonucleotide
  Target: ANGPTL3; (-) strand; PAM type: YTN; PAM sequence: TTT
cataaataaatcatatcaaa

SEQ ID NO: 12839 - DNA, 20 bp, Artificial Sequence
  Description of Artificial Sequence: Synthetic oligonucleotide
  Target: ANGPTL3; (-) strand; PAM type: YTN; PAM sequence: TTA
ggtttcataaataaatcata

SEQ ID NO: 12840 - DNA, 20 bp, Artificial Sequence
  Description of Artificial Sequence: Synthetic oligonucleotide
  Target: ANGPTL3; (-) strand; PAM type: YTN; PAM sequence: TTC
attaggtttcataaataaat

SEQ ID NO: 12841 - DNA, 20 bp, Artificial Sequence
  Description of Artificial Sequence: Synthetic oligonucleotide
  Target: ANGPTL3; (-) strand; PAM type: YTN; PAM sequence: CTT
cattaggtttcataaataaa

SEQ ID NO: 12842 - DNA, 20 bp, Artificial Sequence
  Description of Artificial Sequence: Synthetic oligonucleotide
  Target: ANGPTL3; (-) strand; PAM type: YTN; PAM sequence: CTG
cttcattaggtttcataaat

SEQ ID NO: 12843 - DNA, 20 bp, Artificial Sequence
  Description of Artificial Sequence: Synthetic oligonucleotide
  Target: ANGPTL3; (-) strand; PAM type: YTN; PAM sequence: TTC
tgcttcattaggtttcataa

SEQ ID NO: 12844 - DNA, 20 bp, Artificial Sequence
  Description of Artificial Sequence: Synthetic oligonucleotide
  Target: ANGPTL3; (-) strand; PAM type: YTN; PAM sequence: TTA
attctgcttcattaggtttc

SEQ ID NO: 12845 - DNA, 20 bp, Artificial Sequence
  Description of Artificial Sequence: Synthetic oligonucleotide
  Target: ANGPTL3; (-) strand; PAM type: YTN; PAM sequence: TTT
aattctgcttcattaggttt

SEQ ID NO: 12846 - DNA, 20 bp, Artificial Sequence
  Description of Artificial Sequence: Synthetic oligonucleotide
  Target: ANGPTL3; (-) strand; PAM type: YTN; PAM sequence: TTA
atacagtatttaattctgct

SEQ ID NO: 12847 - DNA, 20 bp, Artificial Sequence
  Description of Artificial Sequence: Synthetic oligonucleotide
  Target: ANGPTL3; (-) strand; PAM type: YTN; PAM sequence: TTT
aatacagtatttaattctgc

SEQ ID NO: 12848 - DNA, 20 bp, Artificial Sequence
  Description of Artificial Sequence: Synthetic oligonucleotide
  Target: ANGPTL3; (-) strand; PAM type: YTN; PAM sequence: TTT
taatacagtatttaattctg

SEQ ID NO: 12849 - DNA, 20 bp, Artificial Sequence
  Description of Artificial Sequence: Synthetic oligonucleotide
  Target: ANGPTL3; (-) strand; PAM type: YTN; PAM sequence: TTA
ttttaatacagtatttaatt

SEQ ID NO: 12850 - DNA, 20 bp, Artificial Sequence
  Description of Artificial Sequence: Synthetic oligonucleotide
  Target: ANGPTL3; (-) strand; PAM type: YTN; PAM sequence: CTT
attttaatacagtatttaat

SEQ ID NO: 12851 - DNA, 20 bp, Artificial Sequence
  Description of Artificial Sequence: Synthetic oligonucleotide
  Target: ANGPTL3; (-) strand; PAM type: YTN; PAM sequence: TTA
aagacagcgaacttatttta

SEQ ID NO: 12852 - DNA, 20 bp, Artificial Sequence
  Description of Artificial Sequence: Synthetic oligonucleotide
  Target: ANGPTL3; (-) strand; PAM type: YTN; PAM sequence: TTT
aaagacagcgaacttatttt

SEQ ID NO: 12853 - DNA, 20 bp, Artificial Sequence
  Description of Artificial Sequence: Synthetic oligonucleotide
  Target: ANGPTL3; (-) strand; PAM type: YTN; PAM sequence: TTG
tttaaagacagcgaacttat

SEQ ID NO: 12854 - DNA, 20 bp, Artificial Sequence
  Description of Artificial Sequence: Synthetic oligonucleotide
  Target: ANGPTL3; (-) strand; PAM type: YTN; PAM sequence: TTT
gtttaaagacagcgaactta

SEQ ID NO: 12855 - DNA, 20 bp, Artificial Sequence
  Description of Artificial Sequence: Synthetic oligonucleotide
  Target: ANGPTL3; (-) strand; PAM type: YTN; PAM sequence: CTC
catttgtttaaagacagcga

SEQ ID NO: 12856 - DNA, 20 bp, Artificial Sequence
  Description of Artificial Sequence: Synthetic oligonucleotide
  Target: ANGPTL3; (-) strand; PAM type: YTN; PAM sequence: TTA
gtagtcatctccatttgttt

SEQ ID NO: 12857 - DNA, 20 bp, Artificial Sequence
  Description of Artificial Sequence: Synthetic oligonucleotide
  Target: ANGPTL3; (-) strand; PAM type: YTN; PAM sequence: CTT
agtagtcatctccatttgtt

SEQ ID NO: 12858 - DNA, 20 bp, Artificial Sequence
  Description of Artificial Sequence: Synthetic oligonucleotide
  Target: ANGPTL3; (-) strand; PAM type: YTN; PAM sequence: TTA
aagtcaatgtgacttagtag

SEQ ID NO: 12859 - DNA, 20 bp, Artificial Sequence
  Description of Artificial Sequence: Synthetic oligonucleotide
  Target: ANGPTL3; (-) strand; PAM type: YTN; PAM sequence: CTC
atgttaaagtcaatgtgact

SEQ ID NO: 12860 - DNA, 20 bp, Artificial Sequence
  Description of Artificial Sequence: Synthetic oligonucleotide
  Target: ANGPTL3; (-) strand; PAM type: YTN; PAM sequence: TTA
acaaataaggtatagtgata

SEQ ID NO: 12861 - DNA, 20 bp, Artificial Sequence
  Description of Artificial Sequence: Synthetic oligonucleotide
  Target: ANGPTL3; (-) strand; PAM type: YTN; PAM sequence: TTT
aacaaataaggtatagtgat

SEQ ID NO: 12862 - DNA, 20 bp, Artificial Sequence
  Description of Artificial Sequence: Synthetic oligonucleotide
  Target: ANGPTL3; (-) strand; PAM type: YTN; PAM sequence: TTT
taacaaataaggtatagtga

SEQ ID NO: 12863 - DNA, 20 bp, Artificial Sequence
  Description of Artificial Sequence: Synthetic oligonucleotide
  Target: ANGPTL3; (-) strand; PAM type: YTN; PAM sequence: TTA
aaatatataaaatgtataca

SEQ ID NO: 12864 - DNA, 20 bp, Artificial Sequence
  Description of Artificial Sequence: Synthetic oligonucleotide
  Target: ANGPTL3; (-) strand; PAM type: YTN; PAM sequence: TTA
agtgttaaaatatataaaat

SEQ ID NO: 12865 - DNA, 20 bp, Artificial Sequence
  Description of Artificial Sequence: Synthetic oligonucleotide
  Target: ANGPTL3; (-) strand; PAM type: YTN; PAM sequence: TTC
atagtattaagtgttaaaat

SEQ ID NO: 12866 - DNA, 20 bp, Artificial Sequence
  Description of Artificial Sequence: Synthetic oligonucleotide
  Target: ANGPTL3; (-) strand; PAM type: YTN; PAM sequence: TTT
catagtattaagtgttaaaa

SEQ ID NO: 12867 - DNA, 20 bp, Artificial Sequence
  Description of Artificial Sequence: Synthetic oligonucleotide
  Target: ANGPTL3; (-) strand; PAM type: YTN; PAM sequence: TTT
tcatagtattaagtgttaaa

SEQ ID NO: 12868 - DNA, 20 bp, Artificial Sequence
  Description of Artificial Sequence: Synthetic oligonucleotide
  Target: ANGPTL3; (-) strand; PAM type: YTN; PAM sequence: TTG
ttttcatagtattaagtgtt

SEQ ID NO: 12869 - DNA, 20 bp, Artificial Sequence
  Description of Artificial Sequence: Synthetic oligonucleotide
  Target: ANGPTL3; (-) strand; PAM type: YTN; PAM sequence: TTT
gttttcatagtattaagtgt

SEQ ID NO: 12870 - DNA, 20 bp, Artificial Sequence
  Description of Artificial Sequence: Synthetic oligonucleotide
  Target: ANGPTL3; (-) strand; PAM type: YTN; PAM sequence: TTA
tttgttttcatagtattaag

SEQ ID NO: 12871 - DNA, 20 bp, Artificial Sequence
  Description of Artificial Sequence: Synthetic oligonucleotide
  Target: ANGPTL3; (-) strand; PAM type: YTN; PAM sequence: TTA
caattatttgttttcatagt

SEQ ID NO: 12872 - DNA, 20 bp, Artificial Sequence
  Description of Artificial Sequence: Synthetic oligonucleotide
  Target: ANGPTL3; (-) strand; PAM type: YTN; PAM sequence: TTT
acaattatttgttttcatag

SEQ ID NO: 12873 - DNA, 20 bp, Artificial Sequence
  Description of Artificial Sequence: Synthetic oligonucleotide
  Target: ANGPTL3; (-) strand; PAM type: YTN; PAM sequence: CTT
tacaattatttgttttcata

SEQ ID NO: 12874 - DNA, 20 bp, Artificial Sequence
  Description of Artificial Sequence: Synthetic oligonucleotide
  Target: ANGPTL3; (-) strand; PAM type: YTN; PAM sequence: TTC
ctttacaattatttgttttc

SEQ ID NO: 12875 - DNA, 20 bp, Artificial Sequence
  Description of Artificial Sequence: Synthetic oligonucleotide
  Target: ANGPTL3; (-) strand; PAM type: YTN; PAM sequence: CTG
acaagattcctttacaatta

SEQ ID NO: 12876 - DNA, 20 bp, Artificial Sequence
  Description of Artificial Sequence: Synthetic oligonucleotide
  Target: ANGPTL3; (-) strand; PAM type: YTN; PAM sequence: CTG
taatctgacaagattccttt

SEQ ID NO: 12877 - DNA, 20 bp, Artificial Sequence
  Description of Artificial Sequence: Synthetic oligonucleotide
  Target: ANGPTL3; (-) strand; PAM type: YTN; PAM sequence: TTA
ctgtaatctgacaagattcc

SEQ ID NO: 12878 - DNA, 20 bp, Artificial Sequence
  Description of Artificial Sequence: Synthetic oligonucleotide
  Target: ANGPTL3; (-) strand; PAM type: YTN; PAM sequence: CTT
actgtaatctgacaagattc

SEQ ID NO: 12879 - DNA, 20 bp, Artificial Sequence
  Description of Artificial Sequence: Synthetic oligonucleotide
  Target: ANGPTL3; (-) strand; PAM type: YTN; PAM sequence: TTC
ttactgtaatctgacaagat

SEQ ID NO: 12880 - DNA, 20 bp, Artificial Sequence
  Description of Artificial Sequence: Synthetic oligonucleotide
  Target: ANGPTL3; (-) strand; PAM type: YTN; PAM sequence: TTC
attcttactgtaatctgaca

SEQ ID NO: 12881 - DNA, 20 bp, Artificial Sequence
  Description of Artificial Sequence: Synthetic oligonucleotide
  Target: ANGPTL3; (-) strand; PAM type: YTN; PAM sequence: CTC
gatgccacaaatatgttcat

SEQ ID NO: 12882 - DNA, 20 bp, Artificial Sequence
  Description of Artificial Sequence: Synthetic oligonucleotide
  Target: ANGPTL3; (-) strand; PAM type: YTN; PAM sequence: TTA
actcgatgccacaaatatgt

SEQ ID NO: 12883 - DNA, 20 bp, Artificial Sequence
  Description of Artificial Sequence: Synthetic oligonucleotide
  Target: ANGPTL3; (-) strand; PAM type: YTN; PAM sequence: TTT
aactcgatgccacaaatatg

SEQ ID NO: 12884 - DNA, 20 bp, Artificial Sequence
  Description of Artificial Sequence: Synthetic oligonucleotide
  Target: ANGPTL3; (-) strand; PAM type: YTN; PAM sequence: CTT
taactcgatgccacaaatat

SEQ ID NO: 12885 - DNA, 20 bp, Artificial Sequence
  Description of Artificial Sequence: Synthetic oligonucleotide
  Target: ANGPTL3; (-) strand; PAM type: YTN; PAM sequence: TTA
ggggaaatataaactttaac

SEQ ID NO: 12886 - DNA, 20 bp, Artificial Sequence
  Description of Artificial Sequence: Synthetic oligonucleotide
  Target: ANGPTL3; (-) strand; PAM type: YTN; PAM sequence: TTT
aggggaaatataaactttaa

SEQ ID NO: 12887 - DNA, 20 bp, Artificial Sequence
  Description of Artificial Sequence: Synthetic oligonucleotide
  Target: ANGPTL3; (-) strand; PAM type: YTN; PAM sequence: TTA
gaatcacagcatatttaggg

SEQ ID NO: 12888 - DNA, 20 bp, Artificial Sequence
  Description of Artificial Sequence: Synthetic oligonucleotide
  Target: ANGPTL3; (-) strand; PAM type: YTN; PAM sequence: CTA
cacgaatgtattagaatcac

SEQ ID NO: 12889 - DNA, 20 bp, Artificial Sequence
  Description of Artificial Sequence: Synthetic oligonucleotide
  Target: ANGPTL3; (-) strand; PAM type: YTN; PAM sequence: TTG
aaaacctacacgaatgtatt

SEQ ID NO: 12890 - DNA, 20 bp, Artificial Sequence
  Description of Artificial Sequence: Synthetic oligonucleotide
  Target: ANGPTL3; (-) strand; PAM type: YTN; PAM sequence: CTT
gaaaacctacacgaatgtat

SEQ ID NO: 12891 - DNA, 20 bp, Artificial Sequence
  Description of Artificial Sequence: Synthetic oligonucleotide
  Target: ANGPTL3; (-) strand; PAM type: YTN; PAM sequence: CTA
cttgaaaacctacacgaatg

SEQ ID NO: 12892 - DNA, 20 bp, Artificial Sequence
  Description of Artificial Sequence: Synthetic oligonucleotide
  Target: ANGPTL3; (-) strand; PAM type: YTN; PAM sequence: TTC
tacttgaaaacctacacgaa

SEQ ID NO: 12893 - DNA, 20 bp, Artificial Sequence
  Description of Artificial Sequence: Synthetic oligonucleotide
  Target: ANGPTL3; (-) strand; PAM type: YTN; PAM sequence: TTT
ctacttgaaaacctacacga

SEQ ID NO: 12894 - DNA, 20 bp, Artificial Sequence
  Description of Artificial Sequence: Synthetic oligonucleotide
  Target: ANGPTL3; (-) strand; PAM type: YTN; PAM sequence: TTA
tttctacttgaaaacctaca

SEQ ID NO: 12895 - DNA, 20 bp, Artificial Sequence
  Description of Artificial Sequence: Synthetic oligonucleotide
  Target: ANGPTL3; (-) strand; PAM type: YTN; PAM sequence: TTT
atttctacttgaaaacctac

SEQ ID NO: 12896 - DNA, 20 bp, Artificial Sequence
  Description of Artificial Sequence: Synthetic oligonucleotide
  Target: ANGPTL3; (-) strand; PAM type: YTN; PAM sequence: TTA
cgaggtttatttctacttga

SEQ ID NO: 12897 - DNA, 20 bp, Artificial Sequence
  Description of Artificial Sequence: Synthetic oligonucleotide
  Target: ANGPTL3; (-) strand; PAM type: YTN; PAM sequence: TTG
ttacgaggtttatttctact

SEQ ID NO: 12898 - DNA, 20 bp, Artificial Sequence
  Description of Artificial Sequence: Synthetic oligonucleotide
  Target: ANGPTL3; (-) strand; PAM type: YTN; PAM sequence: CTT
gttacgaggtttatttctac

SEQ ID NO: 12899 - DNA, 20 bp, Artificial Sequence
  Description of Artificial Sequence: Synthetic oligonucleotide
  Target: ANGPTL3; (-) strand; PAM type: YTN; PAM sequence: TTC
agtaacttgttacgaggttt

SEQ ID NO: 12900 - DNA, 20 bp, Artificial Sequence
  Description of Artificial Sequence: Synthetic oligonucleotide
  Target: ANGPTL3; (-) strand; PAM type: YTN; PAM sequence: TTA
aacgttcagtaacttgttac

SEQ ID NO: 12901 - DNA, 20 bp, Artificial Sequence
  Description of Artificial Sequence: Synthetic oligonucleotide
  Target: ANGPTL3; (-) strand; PAM type: YTN; PAM sequence: TTT
aaacgttcagtaacttgtta

SEQ ID NO: 12902 - DNA, 20 bp, Artificial Sequence
  Description of Artificial Sequence: Synthetic oligonucleotide
  Target: ANGPTL3; (-) strand; PAM type: YTN; PAM sequence: CTG
tttaaacgttcagtaacttg

SEQ ID NO: 12903 - DNA, 20 bp, Artificial Sequence
  Description of Artificial Sequence: Synthetic oligonucleotide
  Target: ANGPTL3; (-) strand; PAM type: YTN; PAM sequence: TTG
tcaggctgtttaaacgttca

SEQ ID NO: 12904 - DNA, 20 bp, Artificial Sequence
  Description of Artificial Sequence: Synthetic oligonucleotide
  Target: ANGPTL3; (-) strand; PAM type: YTN; PAM sequence: CTT
gtcaggctgtttaaacgttc

SEQ ID NO: 12905 - DNA, 20 bp, Artificial Sequence
  Description of Artificial Sequence: Synthetic oligonucleotide
  Target: ANGPTL3; (-) strand; PAM type: YTN; PAM sequence: TTA
aacatatatacatgcttgtc

SEQ ID NO: 12906 - DNA, 20 bp, Artificial Sequence
  Description of Artificial Sequence: Synthetic oligonucleotide
  Target: ANGPTL3; (-) strand; PAM type: YTN; PAM sequence: TTT
aaacatatatacatgcttgt

SEQ ID NO: 12907 - DNA, 20 bp, Artificial Sequence
  Description of Artificial Sequence: Synthetic oligonucleotide
  Target: ANGPTL3; (-) strand; PAM type: YTN; PAM sequence: TTT
taaacatatatacatgcttg

SEQ ID NO: 12908 - DNA, 20 bp, Artificial Sequence
  Description of Artificial Sequence: Synthetic oligonucleotide
  Target: ANGPTL3; (-) strand; PAM type: YTN; PAM sequence: TTG
aattttaaacatatatacat

SEQ ID NO: 12909 - DNA, 20 bp, Artificial Sequence
  Description of Artificial Sequence: Synthetic oligonucleotide
  Target: ANGPTL3; (-) strand; PAM type: YTN; PAM sequence: TTA
ttgaattttaaacatatata

SEQ ID NO: 12910 - DNA, 20 bp, Artificial Sequence
  Description of Artificial Sequence: Synthetic oligonucleotide
  Target: ANGPTL3; (-) strand; PAM type: YTN; PAM sequence: TTT
attgaattttaaacatatat

SEQ ID NO: 12911 - DNA, 20 bp, Artificial Sequence
  Description of Artificial Sequence: Synthetic oligonucleotide
  Target: ANGPTL3; (-) strand; PAM type: YTN; PAM sequence: TTG
tttattgaattttaaacata

SEQ ID NO: 12912 - DNA, 20 bp, Artificial Sequence
  Description of Artificial Sequence: Synthetic oligonucleotide
  Target: ANGPTL3; (-) strand; PAM type: YTN; PAM sequence: TTT
gtttattgaattttaaacat

SEQ ID NO: 12913 - DNA, 20 bp, Artificial Sequence
  Description of Artificial Sequence: Synthetic oligonucleotide
  Target: ANGPTL3; (-) strand; PAM type: YTN; PAM sequence: CTT
tgtttattgaattttaaaca

SEQ ID NO: 12914 - DNA, 20 bp, Artificial Sequence
  Description of Artificial Sequence: Synthetic oligonucleotide
  Target: ANGPTL3; (-) strand; PAM type: YTN; PAM sequence: CTG
ggtctttgtttattgaattt

SEQ ID NO: 12915 - DNA, 20 bp, Artificial Sequence
  Description of Artificial Sequence: Synthetic oligonucleotide
  Target: ANGPTL3; (-) strand; PAM type: YTN; PAM sequence: TTA
gggactgggtctttgtttat

SEQ ID NO: 12916 - DNA, 20 bp, Artificial Sequence
  Description of Artificial Sequence: Synthetic oligonucleotide
  Target: ANGPTL3; (-) strand; PAM type: YTN; PAM sequence: TTT
agggactgggtctttgttta

SEQ ID NO: 12917 - DNA, 20 bp, Artificial Sequence
  Description of Artificial Sequence: Synthetic oligonucleotide
  Target: ANGPTL3; (-) strand; PAM type: YTN; PAM sequence: CTA
taatttagggactgggtctt

SEQ ID NO: 12918 - DNA, 20 bp, Artificial Sequence
  Description of Artificial Sequence: Synthetic oligonucleotide
  Target: ANGPTL3; (-) strand; PAM type: YTN; PAM sequence: TTC
tataatttagggactgggtc

SEQ ID NO: 12919 - DNA, 20 bp, Artificial Sequence
  Description of Artificial Sequence: Synthetic oligonucleotide
  Target: ANGPTL3; (-) strand; PAM type: YTN; PAM sequence: TTT
ctataatttagggactgggt

SEQ ID NO: 12920 - DNA, 20 bp, Artificial Sequence
  Description of Artificial Sequence: Synthetic oligonucleotide
  Target: ANGPTL3; (-) strand; PAM type: YTN; PAM sequence: TTA
aatttctataatttagggac

SEQ ID NO: 12921 - DNA, 20 bp, Artificial Sequence
  Description of Artificial Sequence: Synthetic oligonucleotide
  Target: ANGPTL3; (-) strand; PAM type: YTN; PAM sequence: TTT
aaatttctataatttaggga

SEQ ID NO: 12922 - DNA, 20 bp, Artificial Sequence
  Description of Artificial Sequence: Synthetic oligonucleotide
  Target: ANGPTL3; (-) strand; PAM type: YTN; PAM sequence: TTG
tgatgtcgataaacatgcaa

SEQ ID NO: 12923 - DNA, 20 bp, Artificial Sequence
  Description of Artificial Sequence: Synthetic oligonucleotide
  Target: ANGPTL3; (-) strand; PAM type: YTN; PAM sequence: CTG
ttgtgatgtcgataaacatg

SEQ ID NO: 12924 - DNA, 20 bp, Artificial Sequence
  Description of Artificial Sequence: Synthetic oligonucleotide
  Target: ANGPTL3; (-) strand; PAM type: YTN; PAM sequence: TTA
gggatctgttgtgatgtcga

SEQ ID NO: 12925 - DNA, 20 bp, Artificial Sequence
  Description of Artificial Sequence: Synthetic oligonucleotide
  Target: ANGPTL3; (-) strand; PAM type: YTN; PAM sequence: TTT
agggatctgttgtgatgtcg

SEQ ID NO: 12926 - DNA, 20 bp, Artificial Sequence
  Description of Artificial Sequence: Synthetic oligonucleotide
  Target: ANGPTL3; (-) strand; PAM type: YTN; PAM sequence: TTA
gggatttagggatctgttgt

SEQ ID NO: 12927 - DNA, 20 bp, Artificial Sequence
  Description of Artificial Sequence: Synthetic oligonucleotide
  Target: ANGPTL3; (-) strand; PAM type: YTN; PAM sequence: TTT
agggatttagggatctgttg

SEQ ID NO: 12928 - DNA, 20 bp, Artificial Sequence
  Description of Artificial Sequence: Synthetic oligonucleotide
  Target: ANGPTL3; (-) strand; PAM type: YTN; PAM sequence: TTA
gggatttagggatttaggga

SEQ ID NO: 12929 - DNA, 20 bp, Artificial Sequence
  Description of Artificial Sequence: Synthetic oligonucleotide
  Target: ANGPTL3; (-) strand; PAM type: YTN; PAM sequence: TTT
agggatttagggatttaggg

SEQ ID NO: 12930 - DNA, 20 bp, Artificial Sequence
  Description of Artificial Sequence: Synthetic oligonucleotide
  Target: ANGPTL3; (-) strand; PAM type: YTN; PAM sequence: CTT
tagggatttagggatttagg

SEQ ID NO: 12931 - DNA, 20 bp, Artificial Sequence
  Description of Artificial Sequence: Synthetic oligonucleotide
  Target: ANGPTL3; (-) strand; PAM type: YTN; PAM sequence: CTA
atctttagggatttagggat

SEQ ID NO: 12932 - DNA, 20 bp, Artificial Sequence
  Description of Artificial Sequence: Synthetic oligonucleotide
  Target: ANGPTL3; (-) strand; PAM type: YTN; PAM sequence: TTG
tatctaatctttagggattt

SEQ ID NO: 12933 - DNA, 20 bp, Artificial Sequence
  Description of Artificial Sequence: Synthetic oligonucleotide
  Target: ANGPTL3; (-) strand; PAM type: YTN; PAM sequence: TTT
gtatctaatctttagggatt

SEQ ID NO: 12934 - DNA, 20 bp, Artificial Sequence
  Description of Artificial Sequence: Synthetic oligonucleotide
  Target: ANGPTL3; (-) strand; PAM type: YTN; PAM sequence: CTG
tggtaaaaaatttgtatcta

SEQ ID NO: 12935 - DNA, 20 bp, Artificial Sequence
  Description of Artificial Sequence: Synthetic oligonucleotide
  Target: ANGPTL3; (-) strand; PAM type: YTN; PAM sequence: CTG
acaagtgatactgtggtaaa

SEQ ID NO: 12936 - DNA, 20 bp, Artificial Sequence
  Description of Artificial Sequence: Synthetic oligonucleotide
  Target: ANGPTL3; (-) strand; PAM type: YTN; PAM sequence: TTC
tgacaagtgatactgtggta

SEQ ID NO: 12937 - DNA, 20 bp, Artificial Sequence
  Description of Artificial Sequence: Synthetic oligonucleotide
  Target: ANGPTL3; (-) strand; PAM type: YTN; PAM sequence: TTA
aaaataaattctgacaagtg

SEQ ID NO: 12938 - DNA, 20 bp, Artificial Sequence
  Description of Artificial Sequence: Synthetic oligonucleotide
  Target: ANGPTL3; (-) strand; PAM type: YTN; PAM sequence: TTT
aaaaataaattctgacaagt

SEQ ID NO: 12939 - DNA, 20 bp, Artificial Sequence
  Description of Artificial Sequence: Synthetic oligonucleotide
  Target: ANGPTL3; (-) strand; PAM type: YTN; PAM sequence: TTA
aaaaatcatatttaaaaata

SEQ ID NO: 12940 - DNA, 20 bp, Artificial Sequence
  Description of Artificial Sequence: Synthetic oligonucleotide
  Target: ANGPTL3; (-) strand; PAM type: YTN; PAM sequence: TTT
aaaaaatcatatttaaaaat

SEQ ID NO: 12941 - DNA, 20 bp, Artificial Sequence
  Description of Artificial Sequence: Synthetic oligonucleotide
  Target: ANGPTL3; (-) strand; PAM type: YTN; PAM sequence: TTT
taaaaaatcatatttaaaaa

SEQ ID NO: 12942 - DNA, 20 bp, Artificial Sequence
  Description of Artificial Sequence: Synthetic oligonucleotide
  Target: ANGPTL3; (-) strand; PAM type: YTN; PAM sequence: CTG
gcagttttaaaaaatcatat

SEQ ID NO: 12943 - DNA, 20 bp, Artificial Sequence
  Description of Artificial Sequence: Synthetic oligonucleotide
  Target: ANGPTL3; (-) strand; PAM type: YTN; PAM sequence: TTA
ctggcagttttaaaaaatca

SEQ ID NO: 12944 - DNA, 20 bp, Artificial Sequence
  Description of Artificial Sequence: Synthetic oligonucleotide
  Target: ANGPTL3; (-) strand; PAM type: YTN; PAM sequence: CTT
actggcagttttaaaaaatc

SEQ ID NO: 12945 - DNA, 20 bp, Artificial Sequence
  Description of Artificial Sequence: Synthetic oligonucleotide
  Target: ANGPTL3; (-) strand; PAM type: YTN; PAM sequence: TTC
ttactggcagttttaaaaaa

SEQ ID NO: 12946 - DNA, 20 bp, Artificial Sequence
  Description of Artificial Sequence: Synthetic oligonucleotide
  Target: ANGPTL3; (-) strand; PAM type: YTN; PAM sequence: TTT
cttactggcagttttaaaaa

SEQ ID NO: 12947 - DNA, 20 bp, Artificial Sequence
  Description of Artificial Sequence: Synthetic oligonucleotide
  Target: ANGPTL3; (-) strand; PAM type: YTN; PAM sequence: TTA
aaatttcttactggcagttt

SEQ ID NO: 12948 - DNA, 20 bp, Artificial Sequence
  Description of Artificial Sequence: Synthetic oligonucleotide
  Target: ANGPTL3; (-) strand; PAM type: YTN; PAM sequence: TTT
aaaatttcttactggcagtt

SEQ ID NO: 12949 - DNA, 20 bp, Artificial Sequence
  Description of Artificial Sequence: Synthetic oligonucleotide
  Target: ANGPTL3; (-) strand; PAM type: YTN; PAM sequence: TTA
atttaaaatttcttactggc

SEQ ID NO: 12950 - DNA, 20 bp, Artificial Sequence
  Description of Artificial Sequence: Synthetic oligonucleotide
  Target: ANGPTL3; (-) strand; PAM type: YTN; PAM sequence: TTT
aatttaaaatttcttactgg

SEQ ID NO: 12951 - DNA, 20 bp, Artificial Sequence
  Description of Artificial Sequence: Synthetic oligonucleotide
  Target: ANGPTL3; (-) strand; PAM type: YTN; PAM sequence: TTA
acaaatgggtttaatttaaa

SEQ ID NO: 12952 - DNA, 20 bp, Artificial Sequence
  Description of Artificial Sequence: Synthetic oligonucleotide
  Target: ANGPTL3; (-) strand; PAM type: YTN; PAM sequence: TTT
aacaaatgggtttaatttaa

SEQ ID NO: 12953 - DNA, 20 bp, Artificial Sequence
  Description of Artificial Sequence: Synthetic oligonucleotide
  Target: ANGPTL3; (-) strand; PAM type: YTN; PAM sequence: CTT
taacaaatgggtttaattta

SEQ ID NO: 12954 - DNA, 20 bp, Artificial Sequence
  Description of Artificial Sequence: Synthetic oligonucleotide
  Target: ANGPTL3; (-) strand; PAM type: YTN; PAM sequence: CTA
tatcctttaacaaatgggtt

SEQ ID NO: 12955 - DNA, 20 bp, Artificial Sequence
  Description of Artificial Sequence: Synthetic oligonucleotide
  Target: ANGPTL3; (-) strand; PAM type: YTN; PAM sequence: TTG
ggcactatatcctttaacaa

SEQ ID NO: 12956 - DNA, 20 bp, Artificial Sequence
  Description of Artificial Sequence: Synthetic oligonucleotide
  Target: ANGPTL3; (-) strand; PAM type: YTN; PAM sequence: CTT
gggcactatatcctttaaca

SEQ ID NO: 12957 - DNA, 20 bp, Artificial Sequence
  Description of Artificial Sequence: Synthetic oligonucleotide
  Target: ANGPTL3; (-) strand; PAM type: YTN; PAM sequence: TTG
acaaaggtaggtcaccatat

SEQ ID NO: 12958 - DNA, 20 bp, Artificial Sequence
  Description of Artificial Sequence: Synthetic oligonucleotide
  Target: ANGPTL3; (-) strand; PAM type: YTN; PAM sequence: CTA
agtattgacaaaggtaggtc

SEQ ID NO: 12959 - DNA, 20 bp, Artificial Sequence
  Description of Artificial Sequence: Synthetic oligonucleotide
  Target: ANGPTL3; (-) strand; PAM type: YTN; PAM sequence: TTG
aaatacataatgctaagtat

SEQ ID NO: 12960 - DNA, 20 bp, Artificial Sequence
  Description of Artificial Sequence: Synthetic oligonucleotide
  Target: ANGPTL3; (-) strand; PAM type: YTN; PAM sequence: TTT
gaaatacataatgctaagta

SEQ ID NO: 12961 - DNA, 20 bp, Artificial Sequence
  Description of Artificial Sequence: Synthetic oligonucleotide
  Target: ANGPTL3; (-) strand; PAM type: YTN; PAM sequence: TTG
gataatttgaaatacataat

SEQ ID NO: 12962 - DNA, 20 bp, Artificial Sequence
  Description of Artificial Sequence: Synthetic oligonucleotide
  Target: ANGPTL3; (-) strand; PAM type: YTN; PAM sequence: TTA
tatatgtgacatataaaaat

SEQ ID NO: 12963 - DNA, 20 bp, Artificial Sequence
  Description of Artificial Sequence: Synthetic oligonucleotide
  Target: ANGPTL3; (-) strand; PAM type: YTN; PAM sequence: TTT
atatatgtgacatataaaaa

SEQ ID NO: 12964 - DNA, 20 bp, Artificial Sequence
  Description of Artificial Sequence: Synthetic oligonucleotide
  Target: ANGPTL3; (-) strand; PAM type: YTN; PAM sequence: TTT
tatatatgtgacatataaaa

SEQ ID NO: 12965 - DNA, 20 bp, Artificial Sequence
  Description of Artificial Sequence: Synthetic oligonucleotide
  Target: ANGPTL3; (-) strand; PAM type: YTN; PAM sequence: CTT
ttatatatgtgacatataaa

SEQ ID NO: 12966 - DNA, 20 bp, Artificial Sequence
  Description of Artificial Sequence: Synthetic oligonucleotide
  Target: ANGPTL3; (-) strand; PAM type: YTN; PAM sequence: TTC
acatagatcatacatatctt

SEQ ID NO: 12967 - DNA, 20 bp, Artificial Sequence
  Description of Artificial Sequence: Synthetic oligonucleotide
  Target: ANGPTL3; (-) strand; PAM type: YTN; PAM sequence: TTA
ggattcacatagatcataca

SEQ ID NO: 12968 - DNA, 20 bp, Artificial Sequence
  Description of Artificial Sequence: Synthetic oligonucleotide
  Target: ANGPTL3; (-) strand; PAM type: YTN; PAM sequence: CTT
aggattcacatagatcatac

SEQ ID NO: 12969 - DNA, 20 bp, Artificial Sequence
  Description of Artificial Sequence: Synthetic oligonucleotide
  Target: ANGPTL3; (-) strand; PAM type: YTN; PAM sequence: TTA
cttaggattcacatagatca

SEQ ID NO: 12970 - DNA, 20 bp, Artificial Sequence
  Description of Artificial Sequence: Synthetic oligonucleotide
  Target: ANGPTL3; (-) strand; PAM type: YTN; PAM sequence: TTT
acttaggattcacatagatc

SEQ ID NO: 12971 - DNA, 20 bp, Artificial Sequence
  Description of Artificial Sequence: Synthetic oligonucleotide
  Target: ANGPTL3; (-) strand; PAM type: YTN; PAM sequence: CTG
gaacaaaatatttacttagg

SEQ ID NO: 12972 - DNA, 20 bp, Artificial Sequence
  Description of Artificial Sequence: Synthetic oligonucleotide
  Target: ANGPTL3; (-) strand; PAM type: YTN; PAM sequence: TTC
tggaacaaaatatttactta

SEQ ID NO: 12973 - DNA, 20 bp, Artificial Sequence
  Description of Artificial Sequence: Synthetic oligonucleotide
  Target: ANGPTL3; (-) strand; PAM type: YTN; PAM sequence: TTT
ctggaacaaaatatttactt

SEQ ID NO: 12974 - DNA, 20 bp, Artificial Sequence
  Description of Artificial Sequence: Synthetic oligonucleotide
  Target: ANGPTL3; (-) strand; PAM type: YTN; PAM sequence: TTT
tctggaacaaaatatttact

SEQ ID NO: 12975 - DNA, 20 bp, Artificial Sequence
  Description of Artificial Sequence: Synthetic oligonucleotide
  Target: ANGPTL3; (-) strand; PAM type: YTN; PAM sequence: CTT
ttctggaacaaaatatttac

SEQ ID NO: 12976 - DNA, 20 bp, Artificial Sequence
  Description of Artificial Sequence: Synthetic oligonucleotide
  Target: ANGPTL3; (-) strand; PAM type: YTN; PAM sequence: TTG
tacttttctggaacaaaata

SEQ ID NO: 12977 - DNA, 20 bp, Artificial Sequence
  Description of Artificial Sequence: Synthetic oligonucleotide
  Target: ANGPTL3; (-) strand; PAM type: YTN; PAM sequence: TTT
gtacttttctggaacaaaat

SEQ ID NO: 12978 - DNA, 20 bp, Artificial Sequence
  Description of Artificial Sequence: Synthetic oligonucleotide
  Target: ANGPTL3; (-) strand; PAM type: YTN; PAM sequence: TTT
tgtacttttctggaacaaaa

SEQ ID NO: 12979 - DNA, 20 bp, Artificial Sequence
  Description of Artificial Sequence: Synthetic oligonucleotide
  Target: ANGPTL3; (-) strand; PAM type: YTN; PAM sequence: TTA
ttttgtacttttctggaaca

SEQ ID NO: 12980 - DNA, 20 bp, Artificial Sequence
  Description of Artificial Sequence: Synthetic oligonucleotide
  Target: ANGPTL3; (-) strand; PAM type: YTN; PAM sequence: TTA
ttattttgtacttttctgga

SEQ ID NO: 12981 - DNA, 20 bp, Artificial Sequence
  Description of Artificial Sequence: Synthetic oligonucleotide
  Target: ANGPTL3; (-) strand; PAM type: YTN; PAM sequence: TTT
attattttgtacttttctgg

SEQ ID NO: 12982 - DNA, 20 bp, Artificial Sequence
  Description of Artificial Sequence: Synthetic oligonucleotide
  Target: ANGPTL3; (-) strand; PAM type: YTN; PAM sequence: CTT
tattattttgtacttttctg

SEQ ID NO: 12983 - DNA, 20 bp, Artificial Sequence
  Description of Artificial Sequence: Synthetic oligonucleotide
  Target: ANGPTL3; (-) strand; PAM type: YTN; PAM sequence: TTA
cctttattattttgtacttt

SEQ ID NO: 12984 - DNA, 20 bp, Artificial Sequence
  Description of Artificial Sequence: Synthetic oligonucleotide
  Target: ANGPTL3; (-) strand; PAM type: YTN; PAM sequence: TTT
acctttattattttgtactt

SEQ ID NO: 12985 - DNA, 20 bp, Artificial Sequence
  Description of Artificial Sequence: Synthetic oligonucleotide
  Target: ANGPTL3; (-) strand; PAM type: YTN; PAM sequence: TTT
tacctttattattttgtact

SEQ ID NO: 12986 - DNA, 20 bp, Artificial Sequence
  Description of Artificial Sequence: Synthetic oligonucleotide
  Target: ANGPTL3; (-) strand; PAM type: YTN; PAM sequence: TTT
ttacctttattattttgtac

SEQ ID NO: 12987 - DNA, 20 bp, Artificial Sequence
  Description of Artificial Sequence: Synthetic oligonucleotide
  Target: ANGPTL3; (-) strand; PAM type: YTN; PAM sequence: TTA
tttttacctttattattttg

SEQ ID NO: 12988 - DNA, 20 bp, Artificial Sequence
  Description of Artificial Sequence: Synthetic oligonucleotide
  Target: ANGPTL3; (-) strand; PAM type: YTN; PAM sequence: TTA
tagattatttttacctttat

SEQ ID NO: 12989 - DNA, 20 bp, Artificial Sequence
  Description of Artificial Sequence: Synthetic oligonucleotide
  Target: ANGPTL3; (-) strand; PAM type: YTN; PAM sequence: CTG
aaaattatagattattttta

SEQ ID NO: 12990 - DNA, 20 bp, Artificial Sequence
  Description of Artificial Sequence: Synthetic oligonucleotide
  Target: ANGPTL3; (-) strand; PAM type: YTN; PAM sequence: CTG
tggtcctgaaaattatagat

SEQ ID NO: 12991 - DNA, 20 bp, Artificial Sequence
  Description of Artificial Sequence: Synthetic oligonucleotide
  Target: ANGPTL3; (-) strand; PAM type: YTN; PAM sequence: TTA
gtctgtggtcctgaaaatta

SEQ ID NO: 12992 - DNA, 20 bp, Artificial Sequence
  Description of Artificial Sequence: Synthetic oligonucleotide
  Target: ANGPTL3; (-) strand; PAM type: YTN; PAM sequence: CTT
agtctgtggtcctgaaaatt

SEQ ID NO: 12993 - DNA, 20 bp, Artificial Sequence
  Description of Artificial Sequence: Synthetic oligonucleotide
  Target: ANGPTL3; (-) strand; PAM type: YTN; PAM sequence: TTC
gacagcttagtctgtggtcc

SEQ ID NO: 12994 - DNA, 20 bp, Artificial Sequence
  Description of Artificial Sequence: Synthetic oligonucleotide
  Target: ANGPTL3; (-) strand; PAM type: YTN; PAM sequence: TTT
cgacagcttagtctgtggtc

SEQ ID NO: 12995 - DNA, 20 bp, Artificial Sequence
  Description of Artificial Sequence: Synthetic oligonucleotide
  Target: ANGPTL3; (-) strand; PAM type: YTN; PAM sequence: TTA
atttcgacagcttagtctgt

SEQ ID NO: 12996 - DNA, 20 bp, Artificial Sequence
  Description of Artificial Sequence: Synthetic oligonucleotide
  Target: ANGPTL3; (-) strand; PAM type: YTN; PAM sequence: CTA
aaaaaatcagcgttaatttc

SEQ ID NO: 12997 - DNA, 20 bp, Artificial Sequence
  Description of Artificial Sequence: Synthetic oligonucleotide
  Target: ANGPTL3; (-) strand; PAM type: YTN; PAM sequence: CTG
gccctaaaaaaatcagcgtt

SEQ ID NO: 12998 - DNA, 20 bp, Artificial Sequence
  Description of Artificial Sequence: Synthetic oligonucleotide
  Target: ANGPTL3; (-) strand; PAM type: YTN; PAM sequence: TTC
tggccctaaaaaaatcagcg

SEQ ID NO: 12999 - DNA, 20 bp, Artificial Sequence
  Description of Artificial Sequence: Synthetic oligonucleotide
  Target: ANGPTL3; (-) strand; PAM type: YTN; PAM sequence: TTG
gtattctggccctaaaaaaa

SEQ ID NO: 13000 - DNA, 20 bp, Artificial Sequence
  Description of Artificial Sequence: Synthetic oligonucleotide
  Target: ANGPTL3; (-) strand; PAM type: YTN; PAM sequence: TTT
ggtattctggccctaaaaaa

SEQ ID NO: 13001 - DNA, 20 bp, Artificial Sequence
  Description of Artificial Sequence: Synthetic oligonucleotide
  Target: ANGPTL3; (-) strand; PAM type: YTN; PAM sequence: TTT
tggtattctggccctaaaaa

SEQ ID NO: 13002 - DNA, 20 bp, Artificial Sequence
  Description of Artificial Sequence: Synthetic oligonucleotide
  Target: ANGPTL3; (-) strand; PAM type: YTN; PAM sequence: TTG
ggggaagagaggagccattt

SEQ ID NO: 13003 - DNA, 20 bp, Artificial Sequence
  Description of Artificial Sequence: Synthetic oligonucleotide
  Target: ANGPTL3; (-) strand; PAM type: YTN; PAM sequence: TTT
gggggaagagaggagccatt

SEQ ID NO: 13004 - DNA, 20 bp, Artificial Sequence
  Description of Artificial Sequence: Synthetic oligonucleotide
  Target: ANGPTL3; (-) strand; PAM type: YTN; PAM sequence: TTT
tgggggaagagaggagccat

SEQ ID NO: 13005 - DNA, 20 bp, Artificial Sequence
  Description of Artificial Sequence: Synthetic oligonucleotide
  Target: ANGPTL3; (-) strand; PAM type: YTN; PAM sequence: TTG
tccaattttgggggaagaga

SEQ ID NO: 13006 - DNA, 20 bp, Artificial Sequence
  Description of Artificial Sequence: Synthetic oligonucleotide
  Target: ANGPTL3; (-) strand; PAM type: YTN; PAM sequence: TTG
aaattgtccaattttggggg

SEQ ID NO: 13007 - DNA, 20 bp, Artificial Sequence
  Description of Artificial Sequence: Synthetic oligonucleotide
  Target: ANGPTL3; (-) strand; PAM type: YTN; PAM sequence: TTT
gaaattgtccaattttgggg

SEQ ID NO: 13008 - DNA, 20 bp, Artificial Sequence
  Description of Artificial Sequence: Synthetic oligonucleotide
  Target: ANGPTL3; (-) strand; PAM type: YTN; PAM sequence: TTG
catttgaaattgtccaattt

SEQ ID NO: 13009 - DNA, 20 bp, Artificial Sequence
  Description of Artificial Sequence: Synthetic oligonucleotide
  Target: ANGPTL3; (-) strand; PAM type: YTN; PAM sequence: TTT
gcatttgaaattgtccaatt

SEQ ID NO: 13010 - DNA, 20 bp, Artificial Sequence
  Description of Artificial Sequence: Synthetic oligonucleotide
  Target: ANGPTL3; (-) strand; PAM type: YTN; PAM sequence: TTT
tgcatttgaaattgtccaat

SEQ ID NO: 13011 - DNA, 20 bp, Artificial Sequence
  Description of Artificial Sequence: Synthetic oligonucleotide
  Target: ANGPTL3; (-) strand; PAM type: YTN; PAM sequence: TTA
ttttgcatttgaaattgtcc

SEQ ID NO: 13012 - DNA, 20 bp, Artificial Sequence
  Description of Artificial Sequence: Synthetic oligonucleotide
  Target: ANGPTL3; (-) strand; PAM type: YTN; PAM sequence: TTA
aataatgaattattttgcat

SEQ ID NO: 13013 - DNA, 20 bp, Artificial Sequence
  Description of Artificial Sequence: Synthetic oligonucleotide
  Target: ANGPTL3; (-) strand; PAM type: YTN; PAM sequence: CTC
atatattaaataatgaatta

SEQ ID NO: 13014 - DNA, 20 bp, Artificial Sequence
  Description of Artificial Sequence: Synthetic oligonucleotide
  Target: ANGPTL3; (-) strand; PAM type: YTN; PAM sequence: TTA
aggaaaccaaatagaggaag

SEQ ID NO: 13015 - DNA, 20 bp, Artificial Sequence
  Description of Artificial Sequence: Synthetic oligonucleotide
  Target: ANGPTL3; (-) strand; PAM type: YTN; PAM sequence: TTT
aaggaaaccaaatagaggaa

SEQ ID NO: 13016 - DNA, 20 bp, Artificial Sequence
  Description of Artificial Sequence: Synthetic oligonucleotide
  Target: ANGPTL3; (-) strand; PAM type: YTN; PAM sequence: TTT
taaggaaaccaaatagagga

SEQ ID NO: 13017 - DNA, 20 bp, Artificial Sequence
  Description of Artificial Sequence: Synthetic oligonucleotide
  Target: ANGPTL3; (-) strand; PAM type: YTN; PAM sequence: TTT
ttaaggaaaccaaatagagg

SEQ ID NO: 13018 - DNA, 20 bp, Artificial Sequence
  Description of Artificial Sequence: Synthetic oligonucleotide
  Target: ANGPTL3; (-) strand; PAM type: YTN; PAM sequence: TTT
tttaaggaaaccaaatagag

SEQ ID NO: 13019 - DNA, 20 bp, Artificial Sequence
  Description of Artificial Sequence: Synthetic oligonucleotide
  Target: ANGPTL3; (-) strand; PAM type: YTN; PAM sequence: TTT
ttttaaggaaaccaaataga

SEQ ID NO: 13020 - DNA, 20 bp, Artificial Sequence
  Description of Artificial Sequence: Synthetic oligonucleotide
  Target: ANGPTL3; (-) strand; PAM type: YTN; PAM sequence: TTT
tttttaaggaaaccaaatag

SEQ ID NO: 13021 - DNA, 20 bp, Artificial Sequence
  Description of Artificial Sequence: Synthetic oligonucleotide
  Target: ANGPTL3; (-) strand; PAM type: YTN; PAM sequence: TTT
ttttttaaggaaaccaaata

SEQ ID NO: 13022 - DNA, 20 bp, Artificial Sequence
  Description of Artificial Sequence: Synthetic oligonucleotide
  Target: ANGPTL3; (-) strand; PAM type: YTN; PAM sequence: TTT
tttttttaaggaaaccaaat

SEQ ID NO: 13023 - DNA, 20 bp, Artificial Sequence
  Description of Artificial Sequence: Synthetic oligonucleotide
  Target: ANGPTL3; (-) strand; PAM type: YTN; PAM sequence: TTT
ttttttttaaggaaaccaaa

SEQ ID NO: 13024 - DNA, 20 bp, Artificial Sequence
  Description of Artificial Sequence: Synthetic oligonucleotide
  Target: ANGPTL3; (-) strand; PAM type: YTN; PAM sequence: TTT
tttttttttaaggaaaccaa

SEQ ID NO: 13025 - DNA, 20 bp, Artificial Sequence
  Description of Artificial Sequence: Synthetic oligonucleotide
  Target: ANGPTL3; (-) strand; PAM type: YTN; PAM sequence: TTT
ttttttttttaaggaaacca

SEQ ID NO: 13026 - DNA, 20 bp, Artificial Sequence
  Description of Artificial Sequence: Synthetic oligonucleotide
  Target: ANGPTL3; (-) strand; PAM type: YTN; PAM sequence: TTT
tttttttttttaaggaaacc

SEQ ID NO: 13027 - DNA, 20 bp, Artificial Sequence
  Description of Artificial Sequence: Synthetic oligonucleotide
  Target: ANGPTL3; (-) strand; PAM type: YTN; PAM sequence: CTA
tgagagtttttttttttttt

SEQ ID NO: 13028 - DNA, 20 bp, Artificial Sequence
  Description of Artificial Sequence: Synthetic oligonucleotide
  Target: ANGPTL3; (-) strand; PAM type: YTN; PAM sequence: CTG
aaaggaacaaaatgaaacat

SEQ ID NO: 13029 - DNA, 20 bp, Artificial Sequence
  Description of Artificial Sequence: Synthetic oligonucleotide
  Target: ANGPTL3; (-) strand; PAM type: YTN; PAM sequence: CTC
ctgaaaggaacaaaatgaaa

SEQ ID NO: 13030 - DNA, 20 bp, Artificial Sequence
  Description of Artificial Sequence: Synthetic oligonucleotide
  Target: ANGPTL3; (-) strand; PAM type: YTN; PAM sequence: CTA
ctcctgaaaggaacaaaatg

SEQ ID NO: 13031 - DNA, 20 bp, Artificial Sequence
  Description of Artificial Sequence: Synthetic oligonucleotide
  Target: ANGPTL3; (-) strand; PAM type: YTN; PAM sequence: TTA
ctactcctgaaaggaacaaa

SEQ ID NO: 13032 - DNA, 20 bp, Artificial Sequence
  Description of Artificial Sequence: Synthetic oligonucleotide
  Target: ANGPTL3; (-) strand; PAM type: YTN; PAM sequence: TTT
actactcctgaaaggaacaa

SEQ ID NO: 13033 - DNA, 20 bp, Artificial Sequence
  Description of Artificial Sequence: Synthetic oligonucleotide
  Target: ANGPTL3; (-) strand; PAM type: YTN; PAM sequence: CTA
atttactactcctgaaagga

SEQ ID NO: 13034 - DNA, 20 bp, Artificial Sequence
  Description of Artificial Sequence: Synthetic oligonucleotide
  Target: ANGPTL3; (-) strand; PAM type: YTN; PAM sequence: TTA
tatggggaaaacgtctaatt

SEQ ID NO: 13035 - DNA, 20 bp, Artificial Sequence
  Description of Artificial Sequence: Synthetic oligonucleotide
  Target: ANGPTL3; (-) strand; PAM type: YTN; PAM sequence: TTT
atatggggaaaacgtctaat

SEQ ID NO: 13036 - DNA, 20 bp, Artificial Sequence
  Description of Artificial Sequence: Synthetic oligonucleotide
  Target: ANGPTL3; (-) strand; PAM type: YTN; PAM sequence: CTT
tatatggggaaaacgtctaa

SEQ ID NO: 13037 - DNA, 20 bp, Artificial Sequence
  Description of Artificial Sequence: Synthetic oligonucleotide
  Target: ANGPTL3; (-) strand; PAM type: YTN; PAM sequence: CTG
gtagaaaaaagctttatatg

SEQ ID NO: 13038 - DNA, 20 bp, Artificial Sequence
  Description of Artificial Sequence: Synthetic oligonucleotide
  Target: ANGPTL3; (-) strand; PAM type: YTN; PAM sequence: TTC
tggtagaaaaaagctttata

SEQ ID NO: 13039 - DNA, 20 bp, Artificial Sequence
  Description of Artificial Sequence: Synthetic oligonucleotide
  Target: ANGPTL3; (-) strand; PAM type: YTN; PAM sequence: TTT
ctggtagaaaaaagctttat

SEQ ID NO: 13040 - DNA, 20 bp, Artificial Sequence
  Description of Artificial Sequence: Synthetic oligonucleotide
  Target: ANGPTL3; (-) strand; PAM type: YTN; PAM sequence: CTT
tctggtagaaaaaagcttta

SEQ ID NO: 13041 - DNA, 20 bp, Artificial Sequence
  Description of Artificial Sequence: Synthetic oligonucleotide
  Target: ANGPTL3; (-) strand; PAM type: YTN; PAM sequence: CTA
ccagaagtatctttctggta

SEQ ID NO: 13042 - DNA, 20 bp, Artificial Sequence
  Description of Artificial Sequence: Synthetic oligonucleotide
  Target: ANGPTL3; (-) strand; PAM type: YTN; PAM sequence: TTC
taccagaagtatctttctgg

SEQ ID NO: 13043 - DNA, 20 bp, Artificial Sequence
  Description of Artificial Sequence: Synthetic oligonucleotide
  Target: ANGPTL3; (-) strand; PAM type: YTN; PAM sequence: CTT
ctaccagaagtatctttctg

SEQ ID NO: 13044 - DNA, 20 bp, Artificial Sequence
  Description of Artificial Sequence: Synthetic oligonucleotide
  Target: ANGPTL3; (-) strand; PAM type: YTN; PAM sequence: TTC
ttctaccagaagtatctttc

SEQ ID NO: 13045 - DNA, 20 bp, Artificial Sequence
  Description of Artificial Sequence: Synthetic oligonucleotide
  Target: ANGPTL3; (-) strand; PAM type: YTN; PAM sequence: CTT
cttctaccagaagtatcttt

SEQ ID NO: 13046 - DNA, 20 bp, Artificial Sequence
  Description of Artificial Sequence: Synthetic oligonucleotide
  Target: ANGPTL3; (-) strand; PAM type: YTN; PAM sequence: CTC
ttcttctaccagaagtatct

SEQ ID NO: 13047 - DNA, 20 bp, Artificial Sequence
  Description of Artificial Sequence: Synthetic oligonucleotide
  Target: ANGPTL3; (-) strand; PAM type: YTN; PAM sequence: TTC
tcttcttctaccagaagtat

SEQ ID NO: 13048 - DNA, 20 bp, Artificial Sequence
  Description of Artificial Sequence: Synthetic oligonucleotide
  Target: ANGPTL3; (-) strand; PAM type: YTN; PAM sequence: TTT
ctcttcttctaccagaagta

SEQ ID NO: 13049 - DNA, 20 bp, Artificial Sequence
  Description of Artificial Sequence: Synthetic oligonucleotide
  Target: ANGPTL3; (-) strand; PAM type: YTN; PAM sequence: CTT
tctcttcttctaccagaagt

SEQ ID NO: 13050 - DNA, 20 bp, Artificial Sequence
  Description of Artificial Sequence: Synthetic oligonucleotide
  Target: ANGPTL3; (-) strand; PAM type: YTN; PAM sequence: CTC
ctttctcttcttctaccaga

SEQ ID NO: 13051 - DNA, 20 bp, Artificial Sequence
  Description of Artificial Sequence: Synthetic oligonucleotide
  Target: ANGPTL3; (-) strand; PAM type: YTN; PAM sequence: TTA
ggacaggagacagtcgtgtg

SEQ ID NO: 13052 - DNA, 20 bp, Artificial Sequence
  Description of Artificial Sequence: Synthetic oligonucleotide
  Target: ANGPTL3; (-) strand; PAM type: YTN; PAM sequence: TTA
agcaaagtagttaggacagg

SEQ ID NO: 13053 - DNA, 20 bp, Artificial Sequence
  Description of Artificial Sequence: Synthetic oligonucleotide
  Target: ANGPTL3; (-) strand; PAM type: YTN; PAM sequence: TTT
aagcaaagtagttaggacag

SEQ ID NO: 13054 - DNA, 20 bp, Artificial Sequence
  Description of Artificial Sequence: Synthetic oligonucleotide
  Target: ANGPTL3; (-) strand; PAM type: YTN; PAM sequence: CTT
taagcaaagtagttaggaca

SEQ ID NO: 13055 - DNA, 20 bp, Artificial Sequence
  Description of Artificial Sequence: Synthetic oligonucleotide
  Target: ANGPTL3; (-) strand; PAM type: YTN; PAM sequence: TTG
agcactttaagcaaagtagt

SEQ ID NO: 13056 - DNA, 20 bp, Artificial Sequence
  Description of Artificial Sequence: Synthetic oligonucleotide
  Target: ANGPTL3; (-) strand; PAM type: YTN; PAM sequence: TTT
gagcactttaagcaaagtag

SEQ ID NO: 13057 - DNA, 20 bp, Artificial Sequence
  Description of Artificial Sequence: Synthetic oligonucleotide
  Target: ANGPTL3; (-) strand; PAM type: YTN; PAM sequence: CTG
tgagtagtgatggaatttga

SEQ ID NO: 13058 - DNA, 20 bp, Artificial Sequence
  Description of Artificial Sequence: Synthetic oligonucleotide
  Target: ANGPTL3; (-) strand; PAM type: YTN; PAM sequence: TTA
gacaactgtgagtagtgatg

SEQ ID NO: 13059 - DNA, 20 bp, Artificial Sequence
  Description of Artificial Sequence: Synthetic oligonucleotide
  Target: ANGPTL3; (-) strand; PAM type: YTN; PAM sequence: TTA
gattagacaactgtgagtag

SEQ ID NO: 13060 - DNA, 20 bp, Artificial Sequence
  Description of Artificial Sequence: Synthetic oligonucleotide
  Target: ANGPTL3; (-) strand; PAM type: YTN; PAM sequence: CTT
agattagacaactgtgagta

SEQ ID NO: 13061 - DNA, 20 bp, Artificial Sequence
  Description of Artificial Sequence: Synthetic oligonucleotide
  Target: ANGPTL3; (-) strand; PAM type: YTN; PAM sequence: TTA
gacttagattagacaactgt

SEQ ID NO: 13062 - DNA, 20 bp, Artificial Sequence
  Description of Artificial Sequence: Synthetic oligonucleotide
  Target: ANGPTL3; (-) strand; PAM type: YTN; PAM sequence: CTG
agagatcaaaggggattaga

SEQ ID NO: 13063 - DNA, 20 bp, Artificial Sequence
  Description of Artificial Sequence: Synthetic oligonucleotide
  Target: ANGPTL3; (-) strand; PAM type: YTN; PAM sequence: TTA
agtagtagagagataaaagg

SEQ ID NO: 13064 - DNA, 20 bp, Artificial Sequence
  Description of Artificial Sequence: Synthetic oligonucleotide
  Target: ANGPTL3; (-) strand; PAM type: YTN; PAM sequence: TTA
ttaagtagtagagagataaa

SEQ ID NO: 13065 - DNA, 20 bp, Artificial Sequence
  Description of Artificial Sequence: Synthetic oligonucleotide
  Target: ANGPTL3; (-) strand; PAM type: YTN; PAM sequence: TTA
ttattaagtagtagagagat

SEQ ID NO: 13066 - DNA, 20 bp, Artificial Sequence
  Description of Artificial Sequence: Synthetic oligonucleotide
  Target: ANGPTL3; (-) strand; PAM type: YTN; PAM sequence: CTT
attattaagtagtagagaga

SEQ ID NO: 13067 - DNA, 20 bp, Artificial Sequence
  Description of Artificial Sequence: Synthetic oligonucleotide
  Target: ANGPTL3; (-) strand; PAM type: YTN; PAM sequence: TTC
ttattattaagtagtagaga

SEQ ID NO: 13068 - DNA, 20 bp, Artificial Sequence
  Description of Artificial Sequence: Synthetic oligonucleotide
  Target: ANGPTL3; (-) strand; PAM type: YTN; PAM sequence: TTG
aaaaaaagatattcttatta

SEQ ID NO: 13069 - DNA, 20 bp, Artificial Sequence
  Description of Artificial Sequence: Synthetic oligonucleotide
  Target: ANGPTL3; (-) strand; PAM type: YTN; PAM sequence: TTT
gaaaaaaagatattcttatt

SEQ ID NO: 13070 - DNA, 20 bp, Artificial Sequence
  Description of Artificial Sequence: Synthetic oligonucleotide
  Target: ANGPTL3; (-) strand; PAM type: YTN; PAM sequence: TTG
tgaaagcaaaatgaaggtca

SEQ ID NO: 13071 - DNA, 20 bp, Artificial Sequence
  Description of Artificial Sequence: Synthetic oligonucleotide
  Target: ANGPTL3; (-) strand; PAM type: YTN; PAM sequence: TTC
agataagggataatccatgg

SEQ ID NO: 13072 - DNA, 20 bp, Artificial Sequence
  Description of Artificial Sequence: Synthetic oligonucleotide
  Target: ANGPTL3; (-) strand; PAM type: YTN; PAM sequence: TTA
taaagatggattcagataag

SEQ ID NO: 13073 - DNA, 20 bp, Artificial Sequence
  Description of Artificial Sequence: Synthetic oligonucleotide
  Target: ANGPTL3; (-) strand; PAM type: YTN; PAM sequence: CTA
aatatgagaaaggaataggg

SEQ ID NO: 13074 - DNA, 20 bp, Artificial Sequence
  Description of Artificial Sequence: Synthetic oligonucleotide
  Target: ANGPTL3; (-) strand; PAM type: YTN; PAM sequence: TTG
gcccacagtactaaatatga

SEQ ID NO: 13075 - DNA, 20 bp, Artificial Sequence
  Description of Artificial Sequence: Synthetic oligonucleotide
  Target: ANGPTL3; (-) strand; PAM type: YTN; PAM sequence: TTG
tccattggcccacagtacta

SEQ ID NO: 13076 - DNA, 20 bp, Artificial Sequence
  Description of Artificial Sequence: Synthetic oligonucleotide
  Target: ANGPTL3; (-) strand; PAM type: YTN; PAM sequence: TTG
aaggttgtccattggcccac

SEQ ID NO: 13077 - DNA, 20 bp, Artificial Sequence
  Description of Artificial Sequence: Synthetic oligonucleotide
  Target: ANGPTL3; (-) strand; PAM type: YTN; PAM sequence: CTG
agggtcagtgtagaaaagat

SEQ ID NO: 13078 - DNA, 20 bp, Artificial Sequence
  Description of Artificial Sequence: Synthetic oligonucleotide
  Target: ANGPTL3; (-) strand; PAM type: YTN; PAM sequence: TTC
atggtaaataaaggagtccg

SEQ ID NO: 13079 - DNA, 20 bp, Artificial Sequence
  Description of Artificial Sequence: Synthetic oligonucleotide
  Target: ANGPTL3; (-) strand; PAM type: YTN; PAM sequence: TTA
ttcatggtaaataaaggagt

SEQ ID NO: 13080 - DNA, 20 bp, Artificial Sequence
  Description of Artificial Sequence: Synthetic oligonucleotide
  Target: ANGPTL3; (-) strand; PAM type: YTN; PAM sequence: TTT
attcatggtaaataaaggag

SEQ ID NO: 13081 - DNA, 20 bp, Artificial Sequence
  Description of Artificial Sequence: Synthetic oligonucleotide
  Target: ANGPTL3; (-) strand; PAM type: YTN; PAM sequence: CTT
tattcatggtaaataaagga

SEQ ID NO: 13082 - DNA, 20 bp, Artificial Sequence
  Description of Artificial Sequence: Synthetic oligonucleotide
  Target: ANGPTL3; (-) strand; PAM type: YTN; PAM sequence: TTG
gaactttattcatggtaaat

SEQ ID NO: 13083 - DNA, 20 bp, Artificial Sequence
  Description of Artificial Sequence: Synthetic oligonucleotide
  Target: ANGPTL3; (-) strand; PAM type: YTN; PAM sequence: TTT
ggaactttattcatggtaaa

SEQ ID NO: 13084 - DNA, 20 bp, Artificial Sequence
  Description of Artificial Sequence: Synthetic oligonucleotide
  Target: ANGPTL3; (-) strand; PAM type: YTN; PAM sequence: TTT
tggaactttattcatggtaa

SEQ ID NO: 13085 - DNA, 20 bp, Artificial Sequence
  Description of Artificial Sequence: Synthetic oligonucleotide
  Target: ANGPTL3; (-) strand; PAM type: YTN; PAM sequence: TTG
ggatgaatatgtagattttg

SEQ ID NO: 13086 - DNA, 20 bp, Artificial Sequence
  Description of Artificial Sequence: Synthetic oligonucleotide
  Target: ANGPTL3; (-) strand; PAM type: YTN; PAM sequence: CTT
gggatgaatatgtagatttt

SEQ ID NO: 13087 - DNA, 20 bp, Artificial Sequence
  Description of Artificial Sequence: Synthetic oligonucleotide
  Target: ANGPTL3; (-) strand; PAM type: YTN; PAM sequence: CTG
gaaagagacttgggatgaat

SEQ ID NO: 13088 - DNA, 20 bp, Artificial Sequence
  Description of Artificial Sequence: Synthetic oligonucleotide
  Target: ANGPTL3; (-) strand; PAM type: YTN; PAM sequence: TTG
aagggagaaatggcaaatag

SEQ ID NO: 13089 - DNA, 20 bp, Artificial Sequence
  Description of Artificial Sequence: Synthetic oligonucleotide
  Target: ANGPTL3; (-) strand; PAM type: YTN; PAM sequence: TTG
agtgaagtatagggtattga

SEQ ID NO: 13090 - DNA, 20 bp, Artificial Sequence
  Description of Artificial Sequence: Synthetic oligonucleotide
  Target: ANGPTL3; (-) strand; PAM type: YTN; PAM sequence: TTT
gagtgaagtatagggtattg

SEQ ID NO: 13091 - DNA, 20 bp, Artificial Sequence
  Description of Artificial Sequence: Synthetic oligonucleotide
  Target: ANGPTL3; (-) strand; PAM type: YTN; PAM sequence: TTG
aatttgagtgaagtataggg

SEQ ID NO: 13092 - DNA, 20 bp, Artificial Sequence
  Description of Artificial Sequence: Synthetic oligonucleotide
  Target: ANGPTL3; (-) strand; PAM type: YTN; PAM sequence: TTG
gtatgttgaatttgagtgaa

SEQ ID NO: 13093 - DNA, 20 bp, Artificial Sequence
  Description of Artificial Sequence: Synthetic oligonucleotide
  Target: ANGPTL3; (-) strand; PAM type: YTN; PAM sequence: TTT
ggtatgttgaatttgagtga

SEQ ID NO: 13094 - DNA, 20 bp, Artificial Sequence
  Description of Artificial Sequence: Synthetic oligonucleotide
  Target: ANGPTL3; (-) strand; PAM type: YTN; PAM sequence: TTT
tggtatgttgaatttgagtg

SEQ ID NO: 13095 - DNA, 20 bp, Artificial Sequence
  Description of Artificial Sequence: Synthetic oligonucleotide
  Target: ANGPTL3; (-) strand; PAM type: YTN; PAM sequence: TTT
ttggtatgttgaatttgagt

SEQ ID NO: 13096 - DNA, 20 bp, Artificial Sequence
  Description of Artificial Sequence: Synthetic oligonucleotide
  Target: ANGPTL3; (-) strand; PAM type: YTN; PAM sequence: TTA
tttttggtatgttgaatttg

SEQ ID NO: 13097 - DNA, 20 bp, Artificial Sequence
  Description of Artificial Sequence: Synthetic oligonucleotide
  Target: ANGPTL3; (-) strand; PAM type: YTN; PAM sequence: TTT
atttttggtatgttgaattt

SEQ ID NO: 13098 - DNA, 20 bp, Artificial Sequence
  Description of Artificial Sequence: Synthetic oligonucleotide
  Target: ANGPTL3; (-) strand; PAM type: YTN; PAM sequence: TTT
tatttttggtatgttgaatt

SEQ ID NO: 13099 - DNA, 20 bp, Artificial Sequence
  Description of Artificial Sequence: Synthetic oligonucleotide
  Target: ANGPTL3; (-) strand; PAM type: YTN; PAM sequence: CTT
ttatttttggtatgttgaat

SEQ ID NO: 13100 - DNA, 20 bp, Artificial Sequence
  Description of Artificial Sequence: Synthetic oligonucleotide
  Target: ANGPTL3; (-) strand; PAM type: YTN; PAM sequence: CTG
gccttttatttttggtatgt

SEQ ID NO: 13101 - DNA, 20 bp, Artificial Sequence
  Description of Artificial Sequence: Synthetic oligonucleotide
  Target: ANGPTL3; (-) strand; PAM type: YTN; PAM sequence: TTA
caggtgtgagccaccgtgcc

SEQ ID NO: 13102 - DNA, 20 bp, Artificial Sequence
  Description of Artificial Sequence: Synthetic oligonucleotide
  Target: ANGPTL3; (-) strand; PAM type: YTN; PAM sequence: CTG
ggattacaggtgtgagccac

SEQ ID NO: 13103 - DNA, 20 bp, Artificial Sequence
  Description of Artificial Sequence: Synthetic oligonucleotide
  Target: ANGPTL3; (-) strand; PAM type: YTN; PAM sequence: CTC
ccaaagtcctgggattacag

SEQ ID NO: 13104 - DNA, 20 bp, Artificial Sequence
  Description of Artificial Sequence: Synthetic oligonucleotide
  Target: ANGPTL3; (-) strand; PAM type: YTN; PAM sequence: CTC
agcctcccaaagtcctggga

SEQ ID NO: 13105 - DNA, 20 bp, Artificial Sequence
  Description of Artificial Sequence: Synthetic oligonucleotide
  Target: ANGPTL3; (-) strand; PAM type: YTN; PAM sequence: CTG
cctcagcctcccaaagtcct

SEQ ID NO: 13106 - DNA, 20 bp, Artificial Sequence
  Description of Artificial Sequence: Synthetic oligonucleotide
  Target: ANGPTL3; (-) strand; PAM type: YTN; PAM sequence: CTC
aggtgatccacctgcctcag

SEQ ID NO: 13107 - DNA, 20 bp, Artificial Sequence
  Description of Artificial Sequence: Synthetic oligonucleotide
  Target: ANGPTL3; (-) strand; PAM type: YTN; PAM sequence: CTG
acctcaggtgatccacctgc

SEQ ID NO: 13108 - DNA, 20 bp, Artificial Sequence
  Description of Artificial Sequence: Synthetic oligonucleotide
  Target: ANGPTL3; (-) strand; PAM type: YTN; PAM sequence: CTC
ctgacctcaggtgatccacc

SEQ ID NO: 13109 - DNA, 20 bp, Artificial Sequence
  Description of Artificial Sequence: Synthetic oligonucleotide
  Target: ANGPTL3; (-) strand; PAM type: YTN; PAM sequence: CTG
gtcagactcctgacctcagg

SEQ ID NO: 13110 - DNA, 20 bp, Artificial Sequence
  Description of Artificial Sequence: Synthetic oligonucleotide
  Target: ANGPTL3; (-) strand; PAM type: YTN; PAM sequence: TTG
gtcaggctggtcagactcct

SEQ ID NO: 13111 - DNA, 20 bp, Artificial Sequence
  Description of Artificial Sequence: Synthetic oligonucleotide
  Target: ANGPTL3; (-) strand; PAM type: YTN; PAM sequence: TTC
accatattggtcaggctggt

SEQ ID NO: 13112 - DNA, 20 bp, Artificial Sequence
  Description of Artificial Sequence: Synthetic oligonucleotide
  Target: ANGPTL3; (-) strand; PAM type: YTN; PAM sequence: TTT
caccatattggtcaggctgg

SEQ ID NO: 13113 - DNA, 20 bp, Artificial Sequence
  Description of Artificial Sequence: Synthetic oligonucleotide
  Target: ANGPTL3; (-) strand; PAM type: YTN; PAM sequence: TTA
ggtagagacggggtttcacc

SEQ ID NO: 13114 - DNA, 20 bp, Artificial Sequence
  Description of Artificial Sequence: Synthetic oligonucleotide
  Target: ANGPTL3; (-) strand; PAM type: YTN; PAM sequence: TTT
aggtagagacggggtttcac

SEQ ID NO: 13115 - DNA, 20 bp, Artificial Sequence
  Description of Artificial Sequence: Synthetic oligonucleotide
  Target: ANGPTL3; (-) strand; PAM type: YTN; PAM sequence: TTT
taggtagagacggggtttca

SEQ ID NO: 13116 - DNA, 20 bp, Artificial Sequence
  Description of Artificial Sequence: Synthetic oligonucleotide
  Target: ANGPTL3; (-) strand; PAM type: YTN; PAM sequence: TTG
tattttaggtagagacgggg

SEQ ID NO: 13117 - DNA, 20 bp, Artificial Sequence
  Description of Artificial Sequence: Synthetic oligonucleotide
  Target: ANGPTL3; (-) strand; PAM type: YTN; PAM sequence: TTT
gtattttaggtagagacggg

SEQ ID NO: 13118 - DNA, 20 bp, Artificial Sequence
  Description of Artificial Sequence: Synthetic oligonucleotide
  Target: ANGPTL3; (-) strand; PAM type: YTN; PAM sequence: TTT
tgtattttaggtagagacgg

SEQ ID NO: 13119 - DNA, 20 bp, Artificial Sequence
  Description of Artificial Sequence: Synthetic oligonucleotide
  Target: ANGPTL3; (-) strand; PAM type: YTN; PAM sequence: TTT
ttgtattttaggtagagacg

SEQ ID NO: 13120 - DNA, 20 bp, Artificial Sequence
  Description of Artificial Sequence: Synthetic oligonucleotide
  Target: ANGPTL3; (-) strand; PAM type: YTN; PAM sequence: CTA
atttttgtattttaggtaga

SEQ ID NO: 13121 - DNA, 20 bp, Artificial Sequence
  Description of Artificial Sequence: Synthetic oligonucleotide
  Target: ANGPTL3; (-) strand; PAM type: YTN; PAM sequence: CTG
gctaatttttgtattttagg

SEQ ID NO: 13122 - DNA, 20 bp, Artificial Sequence
  Description of Artificial Sequence: Synthetic oligonucleotide
  Target: ANGPTL3; (-) strand; PAM type: YTN; PAM sequence: CTG
taggcacatgccaccacgcc

SEQ ID NO: 13123 - DNA, 20 bp, Artificial Sequence
  Description of Artificial Sequence: Synthetic oligonucleotide
  Target: ANGPTL3; (-) strand; PAM type: YTN; PAM sequence: CTG
ggactgtaggcacatgccac

SEQ ID NO: 13124 - DNA, 20 bp, Artificial Sequence
  Description of Artificial Sequence: Synthetic oligonucleotide
  Target: ANGPTL3; (-) strand; PAM type: YTN; PAM sequence: TTG
agtagctgggactgtaggca

SEQ ID NO: 13125 - DNA, 20 bp, Artificial Sequence
  Description of Artificial Sequence: Synthetic oligonucleotide
  Target: ANGPTL3; (-) strand; PAM type: YTN; PAM sequence: CTT
gagtagctgggactgtaggc

SEQ ID NO: 13126 - DNA, 20 bp, Artificial Sequence
  Description of Artificial Sequence: Synthetic oligonucleotide
  Target: ANGPTL3; (-) strand; PAM type: YTN; PAM sequence: CTC
ttgagtagctgggactgtag

SEQ ID NO: 13127 - DNA, 20 bp, Artificial Sequence
  Description of Artificial Sequence: Synthetic oligonucleotide
  Target: ANGPTL3; (-) strand; PAM type: YTN; PAM sequence: CTC
agcctcttgagtagctggga

SEQ ID NO: 13128 - DNA, 20 bp, Artificial Sequence
  Description of Artificial Sequence: Synthetic oligonucleotide
  Target: ANGPTL3; (-) strand; PAM type: YTN; PAM sequence: CTG
tctcagcctcttgagtagct

SEQ ID NO: 13129 - DNA, 20 bp, Artificial Sequence
  Description of Artificial Sequence: Synthetic oligonucleotide
  Target: ANGPTL3; (-) strand; PAM type: YTN; PAM sequence: CTC
ctgtctcagcctcttgagta

SEQ ID NO: 13130 - DNA, 20 bp, Artificial Sequence
  Description of Artificial Sequence: Synthetic oligonucleotide
  Target: ANGPTL3; (-) strand; PAM type: YTN; PAM sequence: TTC
tcctgtctcagcctcttgag

SEQ ID NO: 13131 - DNA, 20 bp, Artificial Sequence
  Description of Artificial Sequence: Synthetic oligonucleotide
  Target: ANGPTL3; (-) strand; PAM type: YTN; PAM sequence: TTC
aagcgattctcctgtctcag

SEQ ID NO: 13132 - DNA, 20 bp, Artificial Sequence
  Description of Artificial Sequence: Synthetic oligonucleotide
  Target: ANGPTL3; (-) strand; PAM type: YTN; PAM sequence: CTG
ggttcaagcgattctcctgt

SEQ ID NO: 13133 - DNA, 20 bp, Artificial Sequence
  Description of Artificial Sequence: Synthetic oligonucleotide
  Target: ANGPTL3; (-) strand; PAM type: YTN; PAM sequence: CTC
ctgggttcaagcgattctcc

SEQ ID NO: 13134 - DNA, 20 bp, Artificial Sequence
  Description of Artificial Sequence: Synthetic oligonucleotide
  Target: ANGPTL3; (-) strand; PAM type: YTN; PAM sequence: CTC
cgcctcctgggttcaagcga

SEQ ID NO: 13135 - DNA, 20 bp, Artificial Sequence
  Description of Artificial Sequence: Synthetic oligonucleotide
  Target: ANGPTL3; (-) strand; PAM type: YTN; PAM sequence: CTG
caacctccgcctcctgggtt

SEQ ID NO: 13136 - DNA, 20 bp, Artificial Sequence
  Description of Artificial Sequence: Synthetic oligonucleotide
  Target: ANGPTL3; (-) strand; PAM type: YTN; PAM sequence: CTC
actgcaacctccgcctcctg

SEQ ID NO: 13137 - DNA, 20 bp, Artificial Sequence
  Description of Artificial Sequence: Synthetic oligonucleotide
  Target: ANGPTL3; (-) strand; PAM type: YTN; PAM sequence: CTC
agctcactgcaacctccgcc

SEQ ID NO: 13138 - DNA, 20 bp, Artificial Sequence
  Description of Artificial Sequence: Synthetic oligonucleotide
  Target: ANGPTL3; (-) strand; PAM type: YTN; PAM sequence: TTG
gtgtgatctcagctcactgc

SEQ ID NO: 13139 - DNA, 20 bp, Artificial Sequence
  Description of Artificial Sequence: Synthetic oligonucleotide
  Target: ANGPTL3; (-) strand; PAM type: YTN; PAM sequence: CTG
tcacccagtgcattggtgtg

SEQ ID NO: 13140 - DNA, 20 bp, Artificial Sequence
  Description of Artificial Sequence: Synthetic oligonucleotide
  Target: ANGPTL3; (-) strand; PAM type: YTN; PAM sequence: TTC
tgtcacccagtgcattggtg

SEQ ID NO: 13141 - DNA, 20 bp, Artificial Sequence
  Description of Artificial Sequence: Synthetic oligonucleotide
  Target: ANGPTL3; (-) strand; PAM type: YTN; PAM sequence: TTG
ttctgtcacccagtgcattg

SEQ ID NO: 13142 - DNA, 20 bp, Artificial Sequence
  Description of Artificial Sequence: Synthetic oligonucleotide
  Target: ANGPTL3; (-) strand; PAM type: YTN; PAM sequence: CTT
gttctgtcacccagtgcatt

SEQ ID NO: 13143 - DNA, 20 bp, Artificial Sequence
  Description of Artificial Sequence: Synthetic oligonucleotide
  Target: ANGPTL3; (-) strand; PAM type: YTN; PAM sequence: TTG
agtcagtcttgttctgtcac

SEQ ID NO: 13144 - DNA, 20 bp, Artificial Sequence
  Description of Artificial Sequence: Synthetic oligonucleotide
  Target: ANGPTL3; (-) strand; PAM type: YTN; PAM sequence: TTT
gagtcagtcttgttctgtca

SEQ ID NO: 13145 - DNA, 20 bp, Artificial Sequence
  Description of Artificial Sequence: Synthetic oligonucleotide
  Target: ANGPTL3; (-) strand; PAM type: YTN; PAM sequence: TTT
tgagtcagtcttgttctgtc

SEQ ID NO: 13146 - DNA, 20 bp, Artificial Sequence
  Description of Artificial Sequence: Synthetic oligonucleotide
  Target: ANGPTL3; (-) strand; PAM type: YTN; PAM sequence: TTT
ttgagtcagtcttgttctgt

SEQ ID NO: 13147 - DNA, 20 bp, Artificial Sequence
  Description of Artificial Sequence: Synthetic oligonucleotide
  Target: ANGPTL3; (-) strand; PAM type: YTN; PAM sequence: TTT
tttgagtcagtcttgttctg

SEQ ID NO: 13148 - DNA, 20 bp, Artificial Sequence
  Description of Artificial Sequence: Synthetic oligonucleotide
  Target: ANGPTL3; (-) strand; PAM type: YTN; PAM sequence: TTT
ttttgagtcagtcttgttct

SEQ ID NO: 13149 - DNA, 20 bp, Artificial Sequence
  Description of Artificial Sequence: Synthetic oligonucleotide
  Target: ANGPTL3; (-) strand; PAM type: YTN; PAM sequence: TTT
tttttgagtcagtcttgttc

SEQ ID NO: 13150 - DNA, 20 bp, Artificial Sequence
  Description of Artificial Sequence: Synthetic oligonucleotide
  Target: ANGPTL3; (-) strand; PAM type: YTN; PAM sequence: TTT
ttttttgagtcagtcttgtt

SEQ ID NO: 13151 - DNA, 20 bp, Artificial Sequence
  Description of Artificial Sequence: Synthetic oligonucleotide
  Target: ANGPTL3; (-) strand; PAM type: YTN; PAM sequence: TTA
tttttttttgagtcagtctt

SEQ ID NO: 13152 - DNA, 20 bp, Artificial Sequence
  Description of Artificial Sequence: Synthetic oligonucleotide
  Target: ANGPTL3; (-) strand; PAM type: YTN; PAM sequence: TTT
atttttttttgagtcagtct

SEQ ID NO: 13153 - DNA, 20 bp, Artificial Sequence
  Description of Artificial Sequence: Synthetic oligonucleotide
  Target: ANGPTL3; (-) strand; PAM type: YTN; PAM sequence: TTA
tttatttttttttgagtcag

SEQ ID NO: 13154 - DNA, 20 bp, Artificial Sequence
  Description of Artificial Sequence: Synthetic oligonucleotide
  Target: ANGPTL3; (-) strand; PAM type: YTN; PAM sequence: TTG
ttatttatttttttttgagt

SEQ ID NO: 13155 - DNA, 20 bp, Artificial Sequence
  Description of Artificial Sequence: Synthetic oligonucleotide
  Target: ANGPTL3; (-) strand; PAM type: YTN; PAM sequence: TTT
gttatttatttttttttgag

SEQ ID NO: 13156 - DNA, 20 bp, Artificial Sequence
  Description of Artificial Sequence: Synthetic oligonucleotide
  Target: ANGPTL3; (-) strand; PAM type: YTN; PAM sequence: CTG
gggaatttgttatttatttt

SEQ ID NO: 13157 - DNA, 20 bp, Artificial Sequence
  Description of Artificial Sequence: Synthetic oligonucleotide
  Target: ANGPTL3; (-) strand; PAM type: YTN; PAM sequence: TTA
atggatataaagaagtgagg

SEQ ID NO: 13158 - DNA, 20 bp, Artificial Sequence
  Description of Artificial Sequence: Synthetic oligonucleotide
  Target: ANGPTL3; (-) strand; PAM type: YTN; PAM sequence: CTG
gtcatattaatggatataaa

SEQ ID NO: 13159 - DNA, 20 bp, Artificial Sequence
  Description of Artificial Sequence: Synthetic oligonucleotide
  Target: ANGPTL3; (-) strand; PAM type: YTN; PAM sequence: CTG
ggaacatgctggtcatatta

SEQ ID NO: 13160 - DNA, 20 bp, Artificial Sequence
  Description of Artificial Sequence: Synthetic oligonucleotide
  Target: ANGPTL3; (-) strand; PAM type: YTN; PAM sequence: CTG
tgactgggaacatgctggtc

SEQ ID NO: 13161 - DNA, 20 bp, Artificial Sequence
  Description of Artificial Sequence: Synthetic oligonucleotide
  Target: ANGPTL3; (-) strand; PAM type: YTN; PAM sequence: TTC
tgtgactgggaacatgctgg

SEQ ID NO: 13162 - DNA, 20 bp, Artificial Sequence
  Description of Artificial Sequence: Synthetic oligonucleotide
  Target: ANGPTL3; (-) strand; PAM type: YTN; PAM sequence: CTT
ctgtgactgggaacatgctg

SEQ ID NO: 13163 - DNA, 20 bp, Artificial Sequence
  Description of Artificial Sequence: Synthetic oligonucleotide
  Target: ANGPTL3; (-) strand; PAM type: YTN; PAM sequence: TTC
caggcttctgtgactgggaa

SEQ ID NO: 13164 - DNA, 20 bp, Artificial Sequence
  Description of Artificial Sequence: Synthetic oligonucleotide
  Target: ANGPTL3; (-) strand; PAM type: YTN; PAM sequence: TTC
cgggttccaggcttctgtga

SEQ ID NO: 13165 - DNA, 20 bp, Artificial Sequence
  Description of Artificial Sequence: Synthetic oligonucleotide
  Target: ANGPTL3; (-) strand; PAM type: YTN; PAM sequence: CTT
ccgggttccaggcttctgtg

SEQ ID NO: 13166 - DNA, 20 bp, Artificial Sequence
  Description of Artificial Sequence: Synthetic oligonucleotide
  Target: ANGPTL3; (-) strand; PAM type: YTN; PAM sequence: TTG
agtgaaaagccagagatgtc

SEQ ID NO: 13167 - DNA, 20 bp, Artificial Sequence
  Description of Artificial Sequence: Synthetic oligonucleotide
  Target: ANGPTL3; (-) strand; PAM type: YTN; PAM sequence: TTA
caaagttgagtgaaaagcca

SEQ ID NO: 13168 - DNA, 20 bp, Artificial Sequence
  Description of Artificial Sequence: Synthetic oligonucleotide
  Target: ANGPTL3; (-) strand; PAM type: YTN; PAM sequence: TTT
acaaagttgagtgaaaagcc

SEQ ID NO: 13169 - DNA, 20 bp, Artificial Sequence
  Description of Artificial Sequence: Synthetic oligonucleotide
  Target: ANGPTL3; (-) strand; PAM type: YTN; PAM sequence: TTA
tgatacaaaagaggtagttt

SEQ ID NO: 13170 - DNA, 20 bp, Artificial Sequence
  Description of Artificial Sequence: Synthetic oligonucleotide
  Target: ANGPTL3; (-) strand; PAM type: YTN; PAM sequence: CTT
atgatacaaaagaggtagtt

SEQ ID NO: 13171 - DNA, 20 bp, Artificial Sequence
  Description of Artificial Sequence: Synthetic oligonucleotide
  Target: ANGPTL3; (-) strand; PAM type: YTN; PAM sequence: TTG
gtggcttatgatacaaaaga

SEQ ID NO: 13172 - DNA, 20 bp, Artificial Sequence
  Description of Artificial Sequence: Synthetic oligonucleotide
  Target: ANGPTL3; (-) strand; PAM type: YTN; PAM sequence: CTT
ggtggcttatgatacaaaag

SEQ ID NO: 13173 - DNA, 20 bp, Artificial Sequence
  Description of Artificial Sequence: Synthetic oligonucleotide
  Target: ANGPTL3; (-) strand; PAM type: YTN; PAM sequence: TTG
aacttggtggcttatgatac

SEQ ID NO: 13174 - DNA, 20 bp, Artificial Sequence
  Description of Artificial Sequence: Synthetic oligonucleotide
  Target: ANGPTL3; (-) strand; PAM type: YTN; PAM sequence: TTG
tattgaacttggtggcttat

SEQ ID NO: 13175 - DNA, 20 bp, Artificial Sequence
  Description of Artificial Sequence: Synthetic oligonucleotide
  Target: ANGPTL3; (-) strand; PAM type: YTN; PAM sequence: TTC
aagagaagattgtattgaac

SEQ ID NO: 13176 - DNA, 20 bp, Artificial Sequence
  Description of Artificial Sequence: Synthetic oligonucleotide
  Target: ANGPTL3; (-) strand; PAM type: YTN; PAM sequence: TTT
caagagaagattgtattgaa

SEQ ID NO: 13177 - DNA, 20 bp, Artificial Sequence
  Description of Artificial Sequence: Synthetic oligonucleotide
  Target: ANGPTL3; (-) strand; PAM type: YTN; PAM sequence: TTA
agagacgtttcaagagaaga

SEQ ID NO: 13178 - DNA, 20 bp, Artificial Sequence
  Description of Artificial Sequence: Synthetic oligonucleotide
  Target: ANGPTL3; (-) strand; PAM type: YTN; PAM sequence: TTA
taagattaagagacgtttca

SEQ ID NO: 13179 - DNA, 20 bp, Artificial Sequence
  Description of Artificial Sequence: Synthetic oligonucleotide
  Target: ANGPTL3; (-) strand; PAM type: YTN; PAM sequence: CTT
ataagattaagagacgtttc

SEQ ID NO: 13180 - DNA, 20 bp, Artificial Sequence
  Description of Artificial Sequence: Synthetic oligonucleotide
  Target: ANGPTL3; (-) strand; PAM type: YTN; PAM sequence: TTG
gggaagaaagcttataagat

SEQ ID NO: 13181 - DNA, 20 bp, Artificial Sequence
  Description of Artificial Sequence: Synthetic oligonucleotide
  Target: ANGPTL3; (-) strand; PAM type: YTN; PAM sequence: TTT
ggggaagaaagcttataaga

SEQ ID NO: 13182 - DNA, 20 bp, Artificial Sequence
  Description of Artificial Sequence: Synthetic oligonucleotide
  Target: ANGPTL3; (-) strand; PAM type: YTN; PAM sequence: CTT
tggggaagaaagcttataag

SEQ ID NO: 13183 - DNA, 20 bp, Artificial Sequence
  Description of Artificial Sequence: Synthetic oligonucleotide
  Target: ANGPTL3; (-) strand; PAM type: YTN; PAM sequence: TTA
aagacagtctttggggaaga

SEQ ID NO: 13184 - DNA, 20 bp, Artificial Sequence
  Description of Artificial Sequence: Synthetic oligonucleotide
  Target: ANGPTL3; (-) strand; PAM type: YTN; PAM sequence: CTG
aagttaaagacagtctttgg

SEQ ID NO: 13185 - DNA, 20 bp, Artificial Sequence
  Description of Artificial Sequence: Synthetic oligonucleotide
  Target: ANGPTL3; (-) strand; PAM type: YTN; PAM sequence: CTA
gcactgaagttaaagacagt

SEQ ID NO: 13186 - DNA, 20 bp, Artificial Sequence
  Description of Artificial Sequence: Synthetic oligonucleotide
  Target: ANGPTL3; (-) strand; PAM type: YTN; PAM sequence: TTA
tataatctagcactgaagtt

SEQ ID NO: 13187 - DNA, 20 bp, Artificial Sequence
  Description of Artificial Sequence: Synthetic oligonucleotide
  Target: ANGPTL3; (-) strand; PAM type: YTN; PAM sequence: CTT
atataatctagcactgaagt

SEQ ID NO: 13188 - DNA, 20 bp, Artificial Sequence
  Description of Artificial Sequence: Synthetic oligonucleotide
  Target: ANGPTL3; (-) strand; PAM type: YTN; PAM sequence: CTA
cttatataatctagcactga

SEQ ID NO: 13189 - DNA, 20 bp, Artificial Sequence
  Description of Artificial Sequence: Synthetic oligonucleotide
  Target: ANGPTL3; (-) strand; PAM type: YTN; PAM sequence: TTA
ggaggaaagaagagactact

SEQ ID NO: 13190 - DNA, 20 bp, Artificial Sequence
  Description of Artificial Sequence: Synthetic oligonucleotide
  Target: ANGPTL3; (-) strand; PAM type: YTN; PAM sequence: TTG
acagggagagggacgtaaaa

SEQ ID NO: 13191 - DNA, 20 bp, Artificial Sequence
  Description of Artificial Sequence: Synthetic oligonucleotide
  Target: ANGPTL3; (-) strand; PAM type: YTN; PAM sequence: TTC
ggaagattgacagggagagg

SEQ ID NO: 13192 - DNA, 20 bp, Artificial Sequence
  Description of Artificial Sequence: Synthetic oligonucleotide
  Target: ANGPTL3; (-) strand; PAM type: YTN; PAM sequence: TTT
cggaagattgacagggagag

SEQ ID NO: 13193 - DNA, 20 bp, Artificial Sequence
  Description of Artificial Sequence: Synthetic oligonucleotide
  Target: ANGPTL3; (-) strand; PAM type: YTN; PAM sequence: TTT
tcggaagattgacagggaga

SEQ ID NO: 13194 - DNA, 20 bp, Artificial Sequence
  Description of Artificial Sequence: Synthetic oligonucleotide
  Target: ANGPTL3; (-) strand; PAM type: YTN; PAM sequence: CTT
ttcggaagattgacagggag

SEQ ID NO: 13195 - DNA, 20 bp, Artificial Sequence
  Description of Artificial Sequence: Synthetic oligonucleotide
  Target: ANGPTL3; (-) strand; PAM type: YTN; PAM sequence: TTC
cttttcggaagattgacagg

SEQ ID NO: 13196 - DNA, 20 bp, Artificial Sequence
  Description of Artificial Sequence: Synthetic oligonucleotide
  Target: ANGPTL3; (-) strand; PAM type: YTN; PAM sequence: TTA
caaattccttttcggaagat

SEQ ID NO: 13197 - DNA, 20 bp, Artificial Sequence
  Description of Artificial Sequence: Synthetic oligonucleotide
  Target: ANGPTL3; (-) strand; PAM type: YTN; PAM sequence: TTG
aaagacacaggtccaggcag

SEQ ID NO: 13198 - DNA, 20 bp, Artificial Sequence
  Description of Artificial Sequence: Synthetic oligonucleotide
  Target: ANGPTL3; (-) strand; PAM type: YTN; PAM sequence: CTT
gaaagacacaggtccaggca

SEQ ID NO: 13199 - DNA, 20 bp, Artificial Sequence
  Description of Artificial Sequence: Synthetic oligonucleotide
  Target: ANGPTL3; (-) strand; PAM type: YTN; PAM sequence: TTC
agtagatgagcttgaaagac

SEQ ID NO: 13200 - DNA, 20 bp, Artificial Sequence
  Description of Artificial Sequence: Synthetic oligonucleotide
  Target: ANGPTL3; (-) strand; PAM type: YTN; PAM sequence: CTT
cagtagatgagcttgaaaga

SEQ ID NO: 13201 - DNA, 20 bp, Artificial Sequence
  Description of Artificial Sequence: Synthetic oligonucleotide
  Target: ANGPTL3; (-) strand; PAM type: YTN; PAM sequence: TTC
ttcagtagatgagcttgaaa

SEQ ID NO: 13202 - DNA, 20 bp, Artificial Sequence
  Description of Artificial Sequence: Synthetic oligonucleotide
  Target: ANGPTL3; (-) strand; PAM type: YTN; PAM sequence: CTT
cttcagtagatgagcttgaa

SEQ ID NO: 13203 - DNA, 20 bp, Artificial Sequence
  Description of Artificial Sequence: Synthetic oligonucleotide
  Target: ANGPTL3; (-) strand; PAM type: YTN; PAM sequence: TTA
cacttcttcagtagatgagc

SEQ ID NO: 13204 - DNA, 20 bp, Artificial Sequence
  Description of Artificial Sequence: Synthetic oligonucleotide
  Target: ANGPTL3; (-) strand; PAM type: YTN; PAM sequence: CTG
ttacacttcttcagtagatg

SEQ ID NO: 13205 - DNA, 20 bp, Artificial Sequence
  Description of Artificial Sequence: Synthetic oligonucleotide
  Target: ANGPTL3; (-) strand; PAM type: YTN; PAM sequence: CTG
ctgttacacttcttcagtag

SEQ ID NO: 13206 - DNA, 20 bp, Artificial Sequence
  Description of Artificial Sequence: Synthetic oligonucleotide
  Target: ANGPTL3; (-) strand; PAM type: YTN; PAM sequence: CTC
tgctgttacacttcttcagt

SEQ ID NO: 13207 - DNA, 20 bp, Artificial Sequence
  Description of Artificial Sequence: Synthetic oligonucleotide
  Target: ANGPTL3; (-) strand; PAM type: YTN; PAM sequence: TTA
tcctctgctgttacacttct

SEQ ID NO: 13208 - DNA, 20 bp, Artificial Sequence
  Description of Artificial Sequence: Synthetic oligonucleotide
  Target: ANGPTL3; (-) strand; PAM type: YTN; PAM sequence: TTC
attatcctctgctgttacac

SEQ ID NO: 13209 - DNA, 20 bp, Artificial Sequence
  Description of Artificial Sequence: Synthetic oligonucleotide
  Target: ANGPTL3; (-) strand; PAM type: YTN; PAM sequence: TTT
cattatcctctgctgttaca

SEQ ID NO: 13210 - DNA, 20 bp, Artificial Sequence
  Description of Artificial Sequence: Synthetic oligonucleotide
  Target: ANGPTL3; (-) strand; PAM type: YTN; PAM sequence: TTT
tcattatcctctgctgttac

SEQ ID NO: 13211 - DNA, 20 bp, Artificial Sequence
  Description of Artificial Sequence: Synthetic oligonucleotide
  Target: ANGPTL3; (-) strand; PAM type: YTN; PAM sequence: TTG
ttttcattatcctctgctgt

SEQ ID NO: 13212 - DNA, 20 bp, Artificial Sequence
  Description of Artificial Sequence: Synthetic oligonucleotide
  Target: ANGPTL3; (-) strand; PAM type: YTN; PAM sequence: TTT
gttttcattatcctctgctg

SEQ ID NO: 13213 - DNA, 20 bp, Artificial Sequence
  Description of Artificial Sequence: Synthetic oligonucleotide
  Target: ANGPTL3; (-) strand; PAM type: YTN; PAM sequence: CTC
cagacaataaaaggatttgt

SEQ ID NO: 13214 - DNA, 20 bp, Artificial Sequence
  Description of Artificial Sequence: Synthetic oligonucleotide
  Target: ANGPTL3; (-) strand; PAM type: YTN; PAM sequence: CTG
taactccagacaataaaagg

SEQ ID NO: 13215 - DNA, 20 bp, Artificial Sequence
  Description of Artificial Sequence: Synthetic oligonucleotide
  Target: ANGPTL3; (-) strand; PAM type: YTN; PAM sequence: TTA
tcctgtaactccagacaata

SEQ ID NO: 13216 - DNA, 20 bp, Artificial Sequence
  Description of Artificial Sequence: Synthetic oligonucleotide
  Target: ANGPTL3; (-) strand; PAM type: YTN; PAM sequence: TTT
atcctgtaactccagacaat

SEQ ID NO: 13217 - DNA, 20 bp, Artificial Sequence
  Description of Artificial Sequence: Synthetic oligonucleotide
  Target: ANGPTL3; (-) strand; PAM type: YTN; PAM sequence: TTT
tatcctgtaactccagacaa

SEQ ID NO: 13218 - DNA, 20 bp, Artificial Sequence
  Description of Artificial Sequence: Synthetic oligonucleotide
  Target: ANGPTL3; (-) strand; PAM type: YTN; PAM sequence: TTA
ttttatcctgtaactccaga

SEQ ID NO: 13219 - DNA, 20 bp, Artificial Sequence
  Description of Artificial Sequence: Synthetic oligonucleotide
  Target: ANGPTL3; (-) strand; PAM type: YTN; PAM sequence: TTG
tgcatatagtaagttatttt

SEQ ID NO: 13220 - DNA, 20 bp, Artificial Sequence
  Description of Artificial Sequence: Synthetic oligonucleotide
  Target: ANGPTL3; (-) strand; PAM type: YTN; PAM sequence: TTT
gtgcatatagtaagttattt

SEQ ID NO: 13221 - DNA, 20 bp, Artificial Sequence
  Description of Artificial Sequence: Synthetic oligonucleotide
  Target: ANGPTL3; (-) strand; PAM type: YTN; PAM sequence: CTG
aaagaaatttgtgcatatag

SEQ ID NO: 13222 - DNA, 20 bp, Artificial Sequence
  Description of Artificial Sequence: Synthetic oligonucleotide
  Target: ANGPTL3; (-) strand; PAM type: YTN; PAM sequence: TTC
tgaaagaaatttgtgcatat

SEQ ID NO: 13223 - DNA, 20 bp, Artificial Sequence
  Description of Artificial Sequence: Synthetic oligonucleotide
  Target: ANGPTL3; (-) strand; PAM type: YTN; PAM sequence: CTA
agatcccaataagattctga

SEQ ID NO: 13224 - DNA, 20 bp, Artificial Sequence
  Description of Artificial Sequence: Synthetic oligonucleotide
  Target: ANGPTL3; (-) strand; PAM type: YTN; PAM sequence: TTA
agctaagatcccaataagat

SEQ ID NO: 13225 - DNA, 20 bp, Artificial Sequence
  Description of Artificial Sequence: Synthetic oligonucleotide
  Target: ANGPTL3; (-) strand; PAM type: YTN; PAM sequence: TTT
aagctaagatcccaataaga

SEQ ID NO: 13226 - DNA, 20 bp, Artificial Sequence
  Description of Artificial Sequence: Synthetic oligonucleotide
  Target: ANGPTL3; (-) strand; PAM type: YTN; PAM sequence: CTA
agatttaagctaagatccca

SEQ ID NO: 13227 - DNA, 20 bp, Artificial Sequence
  Description of Artificial Sequence: Synthetic oligonucleotide
  Target: ANGPTL3; (-) strand; PAM type: YTN; PAM sequence: TTC
taagatttaagctaagatcc

SEQ ID NO: 13228 - DNA, 20 bp, Artificial Sequence
  Description of Artificial Sequence: Synthetic oligonucleotide
  Target: ANGPTL3; (-) strand; PAM type: YTN; PAM sequence: TTA
aagtaaaattctaagattta

SEQ ID NO: 13229 - DNA, 20 bp, Artificial Sequence
  Description of Artificial Sequence: Synthetic oligonucleotide
  Target: ANGPTL3; (-) strand; PAM type: YTN; PAM sequence: TTT
aaagtaaaattctaagattt

SEQ ID NO: 13230 - DNA, 20 bp, Artificial Sequence
  Description of Artificial Sequence: Synthetic oligonucleotide
  Target: ANGPTL3; (-) strand; PAM type: YTN; PAM sequence: TTT
taaagtaaaattctaagatt

SEQ ID NO: 13231 - DNA, 20 bp, Artificial Sequence
  Description of Artificial Sequence: Synthetic oligonucleotide
  Target: ANGPTL3; (-) strand; PAM type: YTN; PAM sequence: TTC
atatgcaattttaaagtaaa

SEQ ID NO: 13232 - DNA, 20 bp, Artificial Sequence
  Description of Artificial Sequence: Synthetic oligonucleotide
  Target: ANGPTL3; (-) strand; PAM type: YTN; PAM sequence: TTA
taaagtataaaacacaattc

SEQ ID NO: 13233 - DNA, 20 bp, Artificial Sequence
  Description of Artificial Sequence: Synthetic oligonucleotide
  Target: ANGPTL3; (-) strand; PAM type: YTN; PAM sequence: TTT
ataaagtataaaacacaatt

SEQ ID NO: 13234 - DNA, 20 bp, Artificial Sequence
  Description of Artificial Sequence: Synthetic oligonucleotide
  Target: ANGPTL3; (-) strand; PAM type: YTN; PAM sequence: CTG
caggcatgaagatagattta

SEQ ID NO: 13235 - DNA, 20 bp, Artificial Sequence
  Description of Artificial Sequence: Synthetic oligonucleotide
  Target: ANGPTL3; (-) strand; PAM type: YTN; PAM sequence: TTA
caggtgtgagccactgcagg

SEQ ID NO: 13236 - DNA, 20 bp, Artificial Sequence
  Description of Artificial Sequence: Synthetic oligonucleotide
  Target: ANGPTL3; (-) strand; PAM type: YTN; PAM sequence: TTG
gattacaggtgtgagccact

SEQ ID NO: 13237 - DNA, 20 bp, Artificial Sequence
  Description of Artificial Sequence: Synthetic oligonucleotide
  Target: ANGPTL3; (-) strand; PAM type: YTN; PAM sequence: CTT
ggattacaggtgtgagccac

SEQ ID NO: 13238 - DNA, 20 bp, Artificial Sequence
  Description of Artificial Sequence: Synthetic oligonucleotide
  Target: ANGPTL3; (-) strand; PAM type: YTN; PAM sequence: CTC
ccaaaatacttggattacag

SEQ ID NO: 13239 - DNA, 20 bp, Artificial Sequence
  Description of Artificial Sequence: Synthetic oligonucleotide
  Target: ANGPTL3; (-) strand; PAM type: YTN; PAM sequence: CTC
ccgccccggcctcccaaaat

SEQ ID NO: 13240 - DNA, 20 bp, Artificial Sequence
  Description of Artificial Sequence: Synthetic oligonucleotide
  Target: ANGPTL3; (-) strand; PAM type: YTN; PAM sequence: TTC
aagcagtactcccgccccgg

SEQ ID NO: 13241 - DNA, 20 bp, Artificial Sequence
  Description of Artificial Sequence: Synthetic oligonucleotide
  Target: ANGPTL3; (-) strand; PAM type: YTN; PAM sequence: CTG
ggttcaagcagtactcccgc

SEQ ID NO: 13242 - DNA, 20 bp, Artificial Sequence
  Description of Artificial Sequence: Synthetic oligonucleotide
  Target: ANGPTL3; (-) strand; PAM type: YTN; PAM sequence: CTC
ctgggttcaagcagtactcc

SEQ ID NO: 13243 - DNA, 20 bp, Artificial Sequence
  Description of Artificial Sequence: Synthetic oligonucleotide
  Target: ANGPTL3; (-) strand; PAM type: YTN; PAM sequence: TTG
gactcctgggttcaagcagt

SEQ ID NO: 13244 - DNA, 20 bp, Artificial Sequence
  Description of Artificial Sequence: Synthetic oligonucleotide
  Target: ANGPTL3; (-) strand; PAM type: YTN; PAM sequence: CTT
ggactcctgggttcaagcag

SEQ ID NO: 13245 - DNA, 20 bp, Artificial Sequence
  Description of Artificial Sequence: Synthetic oligonucleotide
  Target: ANGPTL3; (-) strand; PAM type: YTN; PAM sequence: CTG
atcttggactcctgggttca

SEQ ID NO: 13246 - DNA, 20 bp, Artificial Sequence
  Description of Artificial Sequence: Synthetic oligonucleotide
  Target: ANGPTL3; (-) strand; PAM type: YTN; PAM sequence: TTG
cacaggctgatcttggactc

SEQ ID NO: 13247 - DNA, 20 bp, Artificial Sequence
  Description of Artificial Sequence: Synthetic oligonucleotide
  Target: ANGPTL3; (-) strand; PAM type: YTN; PAM sequence: TTG
ccgtgttgcacaggctgatc

SEQ ID NO: 13248 - DNA, 20 bp, Artificial Sequence
  Description of Artificial Sequence: Synthetic oligonucleotide
  Target: ANGPTL3; (-) strand; PAM type: YTN; PAM sequence: TTT
gccgtgttgcacaggctgat

SEQ ID NO: 13249 - DNA, 20 bp, Artificial Sequence
  Description of Artificial Sequence: Synthetic oligonucleotide
  Target: ANGPTL3; (-) strand; PAM type: YTN; PAM sequence: TTT
tgccgtgttgcacaggctga

SEQ ID NO: 13250 - DNA, 20 bp, Artificial Sequence
  Description of Artificial Sequence: Synthetic oligonucleotide
  Target: ANGPTL3; (-) strand; PAM type: YTN; PAM sequence: TTG
tagaggtggagttttgccgt

SEQ ID NO: 13251 - DNA, 20 bp, Artificial Sequence
  Description of Artificial Sequence: Synthetic oligonucleotide
  Target: ANGPTL3; (-) strand; PAM type: YTN; PAM sequence: TTT
gtagaggtggagttttgccg

SEQ ID NO: 13252 - DNA, 20 bp, Artificial Sequence
  Description of Artificial Sequence: Synthetic oligonucleotide
  Target: ANGPTL3; (-) strand; PAM type: YTN; PAM sequence: TTT
tgtagaggtggagttttgcc

SEQ ID NO: 13253 - DNA, 20 bp, Artificial Sequence
  Description of Artificial Sequence: Synthetic oligonucleotide
  Target: ANGPTL3; (-) strand; PAM type: YTN; PAM sequence: TTT
ttgtagaggtggagttttgc

SEQ ID NO: 13254 - DNA, 20 bp, Artificial Sequence
  Description of Artificial Sequence: Synthetic oligonucleotide
  Target: ANGPTL3; (-) strand; PAM type: YTN; PAM sequence: TTT
tttgtagaggtggagttttg

SEQ ID NO: 13255 - DNA, 20 bp, Artificial Sequence
  Description of Artificial Sequence: Synthetic oligonucleotide
  Target: ANGPTL3; (-) strand; PAM type: YTN; PAM sequence: TTG
tattttttgtagaggtggag

SEQ ID NO: 13256 - DNA, 20 bp, Artificial Sequence
  Description of Artificial Sequence: Synthetic oligonucleotide
  Target: ANGPTL3; (-) strand; PAM type: YTN; PAM sequence: TTT
gtattttttgtagaggtgga

SEQ ID NO: 13257 - DNA, 20 bp, Artificial Sequence
  Description of Artificial Sequence: Synthetic oligonucleotide
  Target: ANGPTL3; (-) strand; PAM type: YTN; PAM sequence: TTT
tgtattttttgtagaggtgg

SEQ ID NO: 13258 - DNA, 20 bp, Artificial Sequence
  Description of Artificial Sequence: Synthetic oligonucleotide
  Target: ANGPTL3; (-) strand; PAM type: YTN; PAM sequence: TTT
ttgtattttttgtagaggtg

SEQ ID NO: 13259 - DNA, 20 bp, Artificial Sequence
  Description of Artificial Sequence: Synthetic oligonucleotide
  Target: ANGPTL3; (-) strand; PAM type: YTN; PAM sequence: CTA
atttttgtattttttgtaga

SEQ ID NO: 13260 - DNA, 20 bp, Artificial Sequence
  Description of Artificial Sequence: Synthetic oligonucleotide
  Target: ANGPTL3; (-) strand; PAM type: YTN; PAM sequence: CTG
ccaccacacccagctaattt

SEQ ID NO: 13261 - DNA, 20 bp, Artificial Sequence
  Description of Artificial Sequence: Synthetic oligonucleotide
  Target: ANGPTL3; (-) strand; PAM type: YTN; PAM sequence: TTA
caggcacctgccaccacacc

SEQ ID NO: 13262 - DNA, 20 bp, Artificial Sequence
  Description of Artificial Sequence: Synthetic oligonucleotide
  Target: ANGPTL3; (-) strand; PAM type: YTN; PAM sequence: TTG
ggattacaggcacctgccac

SEQ ID NO: 13263 - DNA, 20 bp, Artificial Sequence
  Description of Artificial Sequence: Synthetic oligonucleotide
  Target: ANGPTL3; (-) strand; PAM type: YTN; PAM sequence: CTC
ccaagtagttgggattacag

SEQ ID NO: 13264 - DNA, 20 bp, Artificial Sequence
  Description of Artificial Sequence: Synthetic oligonucleotide
  Target: ANGPTL3; (-) strand; PAM type: YTN; PAM sequence: CTC
agcctcccaagtagttggga

SEQ ID NO: 13265 - DNA, 20 bp, Artificial Sequence
  Description of Artificial Sequence: Synthetic oligonucleotide
  Target: ANGPTL3; (-) strand; PAM type: YTN; PAM sequence: CTG
cctcagcctcccaagtagtt

SEQ ID NO: 13266 - DNA, 20 bp, Artificial Sequence
  Description of Artificial Sequence: Synthetic oligonucleotide
  Target: ANGPTL3; (-) strand; PAM type: YTN; PAM sequence: CTC
ctgcctcagcctcccaagta

SEQ ID NO: 13267 - DNA, 20 bp, Artificial Sequence
  Description of Artificial Sequence: Synthetic oligonucleotide
  Target: ANGPTL3; (-) strand; PAM type: YTN; PAM sequence: TTC
tcctgcctcagcctcccaag

SEQ ID NO: 13268 - DNA, 20 bp, Artificial Sequence
  Description of Artificial Sequence: Synthetic oligonucleotide
  Target: ANGPTL3; (-) strand; PAM type: YTN; PAM sequence: CTC
cagcgattctcctgcctcag

SEQ ID NO: 13269 - DNA, 20 bp, Artificial Sequence
  Description of Artificial Sequence: Synthetic oligonucleotide
  Target: ANGPTL3; (-) strand; PAM type: YTN; PAM sequence: TTC
ccaggctccagcgattctcc

SEQ ID NO: 13270 - DNA, 20 bp, Artificial Sequence
  Description of Artificial Sequence: Synthetic oligonucleotide
  Target: ANGPTL3; (-) strand; PAM type: YTN; PAM sequence: CTT
cccaggctccagcgattctc

SEQ ID NO: 13271 - DNA, 20 bp, Artificial Sequence
  Description of Artificial Sequence: Synthetic oligonucleotide
  Target: ANGPTL3; (-) strand; PAM type: YTN; PAM sequence: TTG
acttcccaggctccagcgat

SEQ ID NO: 13272 - DNA, 20 bp, Artificial Sequence
  Description of Artificial Sequence: Synthetic oligonucleotide
  Target: ANGPTL3; (-) strand; PAM type: YTN; PAM sequence: CTT
gacttcccaggctccagcga

SEQ ID NO: 13273 - DNA, 20 bp, Artificial Sequence
  Description of Artificial Sequence: Synthetic oligonucleotide
  Target: ANGPTL3; (-) strand; PAM type: YTN; PAM sequence: CTG
caggcttgacttcccaggct

SEQ ID NO: 13274 - DNA, 20 bp, Artificial Sequence
  Description of Artificial Sequence: Synthetic oligonucleotide
  Target: ANGPTL3; (-) strand; PAM type: YTN; PAM sequence: TTC
gctgcaggcttgacttccca

SEQ ID NO: 13275 - DNA, 20 bp, Artificial Sequence
  Description of Artificial Sequence: Synthetic oligonucleotide
  Target: ANGPTL3; (-) strand; PAM type: YTN; PAM sequence: TTA
ggatcatggttcgctgcagg

SEQ ID NO: 13276 - DNA, 20 bp, Artificial Sequence
  Description of Artificial Sequence: Synthetic oligonucleotide
  Target: ANGPTL3; (-) strand; PAM type: YTN; PAM sequence: CTA
gaatgcagtgttaggatcat

SEQ ID NO: 13277 - DNA, 20 bp, Artificial Sequence
  Description of Artificial Sequence: Synthetic oligonucleotide
  Target: ANGPTL3; (-) strand; PAM type: YTN; PAM sequence: TTG
cccaggctagaatgcagtgt

SEQ ID NO: 13278 - DNA, 20 bp, Artificial Sequence
  Description of Artificial Sequence: Synthetic oligonucleotide
  Target: ANGPTL3; (-) strand; PAM type: YTN; PAM sequence: CTG
ttgcccaggctagaatgcag

SEQ ID NO: 13279 - DNA, 20 bp, Artificial Sequence
  Description of Artificial Sequence: Synthetic oligonucleotide
  Target: ANGPTL3; (-) strand; PAM type: YTN; PAM sequence: CTC
tgttgcccaggctagaatgc

SEQ ID NO: 13280 - DNA, 20 bp, Artificial Sequence
  Description of Artificial Sequence: Synthetic oligonucleotide
  Target: ANGPTL3; (-) strand; PAM type: YTN; PAM sequence: CTC
actctgttgcccaggctaga

SEQ ID NO: 13281 - DNA, 20 bp, Artificial Sequence
  Description of Artificial Sequence: Synthetic oligonucleotide
  Target: ANGPTL3; (-) strand; PAM type: YTN; PAM sequence: TTG
agacagagtctcactctgtt

SEQ ID NO: 13282 - DNA, 20 bp, Artificial Sequence
  Description of Artificial Sequence: Synthetic oligonucleotide
  Target: ANGPTL3; (-) strand; PAM type: YTN; PAM sequence: TTT
gagacagagtctcactctgt

SEQ ID NO: 13283 - DNA, 20 bp, Artificial Sequence
  Description of Artificial Sequence: Synthetic oligonucleotide
  Target: ANGPTL3; (-) strand; PAM type: YTN; PAM sequence: TTT
tgagacagagtctcactctg

SEQ ID NO: 13284 - DNA, 20 bp, Artificial Sequence
  Description of Artificial Sequence: Synthetic oligonucleotide
  Target: ANGPTL3; (-) strand; PAM type: YTN; PAM sequence: TTT
ttgagacagagtctcactct

SEQ ID NO: 13285 - DNA, 20 bp, Artificial Sequence
  Description of Artificial Sequence: Synthetic oligonucleotide
  Target: ANGPTL3; (-) strand; PAM type: YTN; PAM sequence: TTT
tttgagacagagtctcactc

SEQ ID NO: 13286 - DNA, 20 bp, Artificial Sequence
  Description of Artificial Sequence: Synthetic oligonucleotide
  Target: ANGPTL3; (-) strand; PAM type: YTN; PAM sequence: TTT
ttttgagacagagtctcact

SEQ ID NO: 13287 - DNA, 20 bp, Artificial Sequence
  Description of Artificial Sequence: Synthetic oligonucleotide
  Target: ANGPTL3; (-) strand; PAM type: YTN; PAM sequence: TTT
tttttgagacagagtctcac

SEQ ID NO: 13288 - DNA, 20 bp, Artificial Sequence
  Description of Artificial Sequence: Synthetic oligonucleotide
  Target: ANGPTL3; (-) strand; PAM type: YTN; PAM sequence: TTA
tatgaagattttttttgaga

SEQ ID NO: 13289 - DNA, 20 bp, Artificial Sequence
  Description of Artificial Sequence: Synthetic oligonucleotide
  Target: ANGPTL3; (-) strand; PAM type: YTN; PAM sequence: TTT
atatgaagattttttttgag

SEQ ID NO: 13290 - DNA, 20 bp, Artificial Sequence
  Description of Artificial Sequence: Synthetic oligonucleotide
  Target: ANGPTL3; (-) strand; PAM type: YTN; PAM sequence: TTT
tatatgaagattttttttga

SEQ ID NO: 13291 - DNA, 20 bp, Artificial Sequence
  Description of Artificial Sequence: Synthetic oligonucleotide
  Target: ANGPTL3; (-) strand; PAM type: YTN; PAM sequence: TTT
ttatatgaagattttttttg

SEQ ID NO: 13292 - DNA, 20 bp, Artificial Sequence
  Description of Artificial Sequence: Synthetic oligonucleotide
  Target: ANGPTL3; (-) strand; PAM type: YTN; PAM sequence: TTG
gggggaaataaatattttta

SEQ ID NO: 13293 - DNA, 20 bp, Artificial Sequence
  Description of Artificial Sequence: Synthetic oligonucleotide
  Target: ANGPTL3; (-) strand; PAM type: YTN; PAM sequence: CTT
ggggggaaataaatattttt

SEQ ID NO: 13294 - DNA, 20 bp, Artificial Sequence
  Description of Artificial Sequence: Synthetic oligonucleotide
  Target: ANGPTL3; (-) strand; PAM type: YTN; PAM sequence: TTA
aatacttggggggaaataaa

SEQ ID NO: 13295 - DNA, 20 bp, Artificial Sequence
  Description of Artificial Sequence: Synthetic oligonucleotide
  Target: ANGPTL3; (-) strand; PAM type: YTN; PAM sequence: TTT
aaatacttggggggaaataa

SEQ ID NO: 13296 - DNA, 20 bp, Artificial Sequence
  Description of Artificial Sequence: Synthetic oligonucleotide
  Target: ANGPTL3; (-) strand; PAM type: YTN; PAM sequence: TTT
taaatacttggggggaaata

SEQ ID NO: 13297 - DNA, 20 bp, Artificial Sequence
  Description of Artificial Sequence: Synthetic oligonucleotide
  Target: ANGPTL3; (-) strand; PAM type: YTN; PAM sequence: TTT
ttaaatacttggggggaaat

SEQ ID NO: 13298 - DNA, 20 bp, Artificial Sequence
  Description of Artificial Sequence: Synthetic oligonucleotide
  Target: ANGPTL3; (-) strand; PAM type: YTN; PAM sequence: CTT
tttaaatacttggggggaaa

SEQ ID NO: 13299 - DNA, 20 bp, Artificial Sequence
  Description of Artificial Sequence: Synthetic oligonucleotide
  Target: ANGPTL3; (-) strand; PAM type: YTN; PAM sequence: CTA
ggaacatcactttttaaata

SEQ ID NO: 13300 - DNA, 20 bp, Artificial Sequence
  Description of Artificial Sequence: Synthetic oligonucleotide
  Target: ANGPTL3; (-) strand; PAM type: YTN; PAM sequence: TTC
taggaacatcactttttaaa

SEQ ID NO: 13301 - DNA, 20 bp, Artificial Sequence
  Description of Artificial Sequence: Synthetic oligonucleotide
  Target: ANGPTL3; (-) strand; PAM type: YTN; PAM sequence: CTT
ctaggaacatcactttttaa

SEQ ID NO: 13302 - DNA, 20 bp, Artificial Sequence
  Description of Artificial Sequence: Synthetic oligonucleotide
  Target: ANGPTL3; (-) strand; PAM type: YTN; PAM sequence: TTC
acaggataaacatgacacat

SEQ ID NO: 13303 - DNA, 20 bp, Artificial Sequence
  Description of Artificial Sequence: Synthetic oligonucleotide
  Target: ANGPTL3; (-) strand; PAM type: YTN; PAM sequence: CTA
tatgggacgtgcaagttcac

SEQ ID NO: 13304 - DNA, 20 bp, Artificial Sequence
  Description of Artificial Sequence: Synthetic oligonucleotide
  Target: ANGPTL3; (-) strand; PAM type: YTN; PAM sequence: TTG
tgagggcacaactatatggg

SEQ ID NO: 13305 - DNA, 20 bp, Artificial Sequence
  Description of Artificial Sequence: Synthetic oligonucleotide
  Target: ANGPTL3; (-) strand; PAM type: YTN; PAM sequence: CTT
gtgagggcacaactatatgg

SEQ ID NO: 13306 - DNA, 20 bp, Artificial Sequence
  Description of Artificial Sequence: Synthetic oligonucleotide
  Target: ANGPTL3; (-) strand; PAM type: YTN; PAM sequence: TTC
ttgtgagggcacaactatat

SEQ ID NO: 13307 - DNA, 20 bp, Artificial Sequence
  Description of Artificial Sequence: Synthetic oligonucleotide
  Target: ANGPTL3; (-) strand; PAM type: YTN; PAM sequence: TTG
gagtatacattcttgtgagg

SEQ ID NO: 13308 - DNA, 20 bp, Artificial Sequence
  Description of Artificial Sequence: Synthetic oligonucleotide
  Target: ANGPTL3; (-) strand; PAM type: YTN; PAM sequence: CTA
attggagtatacattcttgt

SEQ ID NO: 13309 - DNA, 20 bp, Artificial Sequence
  Description of Artificial Sequence: Synthetic oligonucleotide
  Target: ANGPTL3; (-) strand; PAM type: YTN; PAM sequence: TTC
taattggagtatacattctt

SEQ ID NO: 13310 - DNA, 20 bp, Artificial Sequence
  Description of Artificial Sequence: Synthetic oligonucleotide
  Target: ANGPTL3; (-) strand; PAM type: YTN; PAM sequence: CTT
ctaattggagtatacattct

SEQ ID NO: 13311 - DNA, 20 bp, Artificial Sequence
  Description of Artificial Sequence: Synthetic oligonucleotide
  Target: ANGPTL3; (-) strand; PAM type: YTN; PAM sequence: CTC
ttctaattggagtatacatt

SEQ ID NO: 13312 - DNA, 20 bp, Artificial Sequence
  Description of Artificial Sequence: Synthetic oligonucleotide
  Target: ANGPTL3; (-) strand; PAM type: YTN; PAM sequence: CTA
tactcttctaattggagtat

SEQ ID NO: 13313 - DNA, 20 bp, Artificial Sequence
  Description of Artificial Sequence: Synthetic oligonucleotide
  Target: ANGPTL3; (-) strand; PAM type: YTN; PAM sequence: TTC
caaaggcctatactcttcta

SEQ ID NO: 13314 - DNA, 20 bp, Artificial Sequence
  Description of Artificial Sequence: Synthetic oligonucleotide
  Target: ANGPTL3; (-) strand; PAM type: YTN; PAM sequence: TTG
ttccaaaggcctatactctt

SEQ ID NO: 13315 - DNA, 20 bp, Artificial Sequence
  Description of Artificial Sequence: Synthetic oligonucleotide
  Target: ANGPTL3; (-) strand; PAM type: YTN; PAM sequence: TTT
gttccaaaggcctatactct

SEQ ID NO: 13316 - DNA, 20 bp, Artificial Sequence
  Description of Artificial Sequence: Synthetic oligonucleotide
  Target: ANGPTL3; (-) strand; PAM type: YTN; PAM sequence: TTT
tgttccaaaggcctatactc

SEQ ID NO: 13317 - DNA, 20 bp, Artificial Sequence
  Description of Artificial Sequence: Synthetic oligonucleotide
  Target: ANGPTL3; (-) strand; PAM type: YTN; PAM sequence: TTG
gattttgttccaaaggccta

SEQ ID NO: 13318 - DNA, 20 bp, Artificial Sequence
  Description of Artificial Sequence: Synthetic oligonucleotide
  Target: ANGPTL3; (-) strand; PAM type: YTN; PAM sequence: TTT
ggattttgttccaaaggcct

SEQ ID NO: 13319 - DNA, 20 bp, Artificial Sequence
  Description of Artificial Sequence: Synthetic oligonucleotide
  Target: ANGPTL3; (-) strand; PAM type: YTN; PAM sequence: TTT
tggattttgttccaaaggcc

SEQ ID NO: 13320 - DNA, 20 bp, Artificial Sequence
  Description of Artificial Sequence: Synthetic oligonucleotide
  Target: ANGPTL3; (-) strand; PAM type: YTN; PAM sequence: CTG
gaaggattttggattttgtt

SEQ ID NO: 13321 - DNA, 20 bp, Artificial Sequence
  Description of Artificial Sequence: Synthetic oligonucleotide
  Target: ANGPTL3; (-) strand; PAM type: YTN; PAM sequence: TTG
aaaacctggaaggattttgg

SEQ ID NO: 13322 - DNA, 20 bp, Artificial Sequence
  Description of Artificial Sequence: Synthetic oligonucleotide
  Target: ANGPTL3; (-) strand; PAM type: YTN; PAM sequence: TTT
gaaaacctggaaggattttg

SEQ ID NO: 13323 - DNA, 20 bp, Artificial Sequence
  Description of Artificial Sequence: Synthetic oligonucleotide
  Target: ANGPTL3; (-) strand; PAM type: YTN; PAM sequence: TTT
tgaaaacctggaaggatttt

SEQ ID NO: 13324 - DNA, 20 bp, Artificial Sequence
  Description of Artificial Sequence: Synthetic oligonucleotide
  Target: ANGPTL3; (-) strand; PAM type: YTN; PAM sequence: CTT
ttgaaaacctggaaggattt

SEQ ID NO: 13325 - DNA, 20 bp, Artificial Sequence
  Description of Artificial Sequence: Synthetic oligonucleotide
  Target: ANGPTL3; (-) strand; PAM type: YTN; PAM sequence: TTG
gggccaggtgatagagactt

SEQ ID NO: 13326 - DNA, 20 bp, Artificial Sequence
  Description of Artificial Sequence: Synthetic oligonucleotide
  Target: ANGPTL3; (-) strand; PAM type: YTN; PAM sequence: TTT
ggggccaggtgatagagact

SEQ ID NO: 13327 - DNA, 20 bp, Artificial Sequence
  Description of Artificial Sequence: Synthetic oligonucleotide
  Target: ANGPTL3; (-) strand; PAM type: YTN; PAM sequence: CTG
aagaggtaatttggggccag

SEQ ID NO: 13328 - DNA, 20 bp, Artificial Sequence
  Description of Artificial Sequence: Synthetic oligonucleotide
  Target: ANGPTL3; (-) strand; PAM type: YTN; PAM sequence: TTG
tgggaaaaaatggctgaaga

SEQ ID NO: 13329 - DNA, 20 bp, Artificial Sequence
  Description of Artificial Sequence: Synthetic oligonucleotide
  Target: ANGPTL3; (-) strand; PAM type: YTN; PAM sequence: TTG
tgttgtgggaaaaaatggct

SEQ ID NO: 13330 - DNA, 20 bp, Artificial Sequence
  Description of Artificial Sequence: Synthetic oligonucleotide
  Target: ANGPTL3; (-) strand; PAM type: YTN; PAM sequence: TTT
gtgttgtgggaaaaaatggc

SEQ ID NO: 13331 - DNA, 20 bp, Artificial Sequence
  Description of Artificial Sequence: Synthetic oligonucleotide
  Target: ANGPTL3; (-) strand; PAM type: YTN; PAM sequence: TTG
atgagagcagaaggtttgtg

SEQ ID NO: 13332 - DNA, 20 bp, Artificial Sequence
  Description of Artificial Sequence: Synthetic oligonucleotide
  Target: ANGPTL3; (-) strand; PAM type: YTN; PAM sequence: TTT
gatgagagcagaaggtttgt

SEQ ID NO: 13333 - DNA, 20 bp, Artificial Sequence
  Description of Artificial Sequence: Synthetic oligonucleotide
  Target: ANGPTL3; (-) strand; PAM type: YTN; PAM sequence: TTT
tgatgagagcagaaggtttg

SEQ ID NO: 13334 - DNA, 20 bp, Artificial Sequence
  Description of Artificial Sequence: Synthetic oligonucleotide
  Target: ANGPTL3; (-) strand; PAM type: YTN; PAM sequence: TTA
aaagtagatcgttttgatga

SEQ ID NO: 13335 - DNA, 20 bp, Artificial Sequence
  Description of Artificial Sequence: Synthetic oligonucleotide
  Target: ANGPTL3; (-) strand; PAM type: YTN; PAM sequence: TTT
aaaagtagatcgttttgatg

SEQ ID NO: 13336 - DNA, 20 bp, Artificial Sequence
  Description of Artificial Sequence: Synthetic oligonucleotide
  Target: ANGPTL3; (-) strand; PAM type: YTN; PAM sequence: TTA
ggaaggcatagaggagatgt

SEQ ID NO: 13337 - DNA, 20 bp, Artificial Sequence
  Description of Artificial Sequence: Synthetic oligonucleotide
  Target: ANGPTL3; (-) strand; PAM type: YTN; PAM sequence: CTA
gacaaatggaatacattagg

SEQ ID NO: 13338 - DNA, 20 bp, Artificial Sequence
  Description of Artificial Sequence: Synthetic oligonucleotide
  Target: ANGPTL3; (-) strand; PAM type: YTN; PAM sequence: TTC
tagacaaatggaatacatta

SEQ ID NO: 13339 - DNA, 20 bp, Artificial Sequence
  Description of Artificial Sequence: Synthetic oligonucleotide
  Target: ANGPTL3; (-) strand; PAM type: YTN; PAM sequence: CTA
gccaatcagaaatgtgtggg

SEQ ID NO: 13340 - DNA, 20 bp, Artificial Sequence
  Description of Artificial Sequence: Synthetic oligonucleotide
  Target: ANGPTL3; (-) strand; PAM type: YTN; PAM sequence: TTA
aaatacggcacaatctagcc

SEQ ID NO: 13341 - DNA, 20 bp, Artificial Sequence
  Description of Artificial Sequence: Synthetic oligonucleotide
  Target: ANGPTL3; (-) strand; PAM type: YTN; PAM sequence: CTT
aaaatacggcacaatctagc

SEQ ID NO: 13342 - DNA, 20 bp, Artificial Sequence
  Description of Artificial Sequence: Synthetic oligonucleotide
  Target: ANGPTL3; (-) strand; PAM type: YTN; PAM sequence: CTG
caccttaaaatacggcacaa

SEQ ID NO: 13343 - DNA, 20 bp, Artificial Sequence
  Description of Artificial Sequence: Synthetic oligonucleotide
  Target: ANGPTL3; (-) strand; PAM type: YTN; PAM sequence: TTG
agatatctgcaccttaaaat

SEQ ID NO: 13344 - DNA, 20 bp, Artificial Sequence
  Description of Artificial Sequence: Synthetic oligonucleotide
  Target: ANGPTL3; (-) strand; PAM type: YTN; PAM sequence: TTG
tggaagaattgagatatctg

SEQ ID NO: 13345 - DNA, 20 bp, Artificial Sequence
  Description of Artificial Sequence: Synthetic oligonucleotide
  Target: ANGPTL3; (-) strand; PAM type: YTN; PAM sequence: TTT
gtggaagaattgagatatct

SEQ ID NO: 13346 - DNA, 20 bp, Artificial Sequence
  Description of Artificial Sequence: Synthetic oligonucleotide
  Target: ANGPTL3; (-) strand; PAM type: YTN; PAM sequence: CTA
gaatatttgtggaagaattg

SEQ ID NO: 13347 - DNA, 20 bp, Artificial Sequence
  Description of Artificial Sequence: Synthetic oligonucleotide
  Target: ANGPTL3; (-) strand; PAM type: YTN; PAM sequence: TTA
ctagaatatttgtggaagaa

SEQ ID NO: 13348 - DNA, 20 bp, Artificial Sequence
  Description of Artificial Sequence: Synthetic oligonucleotide
  Target: ANGPTL3; (-) strand; PAM type: YTN; PAM sequence: TTT
actagaatatttgtggaaga

SEQ ID NO: 13349 - DNA, 20 bp, Artificial Sequence
  Description of Artificial Sequence: Synthetic oligonucleotide
  Target: ANGPTL3; (-) strand; PAM type: YTN; PAM sequence: CTG
ccatttactagaatatttgt

SEQ ID NO: 13350 - DNA, 20 bp, Artificial Sequence
  Description of Artificial Sequence: Synthetic oligonucleotide
  Target: ANGPTL3; (-) strand; PAM type: YTN; PAM sequence: TTC
agatgaacaagctgccattt

SEQ ID NO: 13351 - DNA, 20 bp, Artificial Sequence
  Description of Artificial Sequence: Synthetic oligonucleotide
  Target: ANGPTL3; (-) strand; PAM type: YTN; PAM sequence: TTT
cagatgaacaagctgccatt

SEQ ID NO: 13352 - DNA, 20 bp, Artificial Sequence
  Description of Artificial Sequence: Synthetic oligonucleotide
  Target: ANGPTL3; (-) strand; PAM type: YTN; PAM sequence: CTG
tgtggtttcagatgaacaag

SEQ ID NO: 13353 - DNA, 20 bp, Artificial Sequence
  Description of Artificial Sequence: Synthetic oligonucleotide
  Target: ANGPTL3; (-) strand; PAM type: YTN; PAM sequence: TTC
tgtgtggtttcagatgaaca

SEQ ID NO: 13354 - DNA, 20 bp, Artificial Sequence
  Description of Artificial Sequence: Synthetic oligonucleotide
  Target: ANGPTL3; (-) strand; PAM type: YTN; PAM sequence: TTG
aggtgtatggacagtaattc

SEQ ID NO: 13355 - DNA, 20 bp, Artificial Sequence
  Description of Artificial Sequence: Synthetic oligonucleotide
  Target: ANGPTL3; (-) strand; PAM type: YTN; PAM sequence: TTT
gaggtgtatggacagtaatt

SEQ ID NO: 13356 - DNA, 20 bp, Artificial Sequence
  Description of Artificial Sequence: Synthetic oligonucleotide
  Target: ANGPTL3; (-) strand; PAM type: YTN; PAM sequence: CTA
agtgccatttgaggtgtatg

SEQ ID NO: 13357 - DNA, 20 bp, Artificial Sequence
  Description of Artificial Sequence: Synthetic oligonucleotide
  Target: ANGPTL3; (-) strand; PAM type: YTN; PAM sequence: CTC
actaagtgccatttgaggtg

SEQ ID NO: 13358 - DNA, 20 bp, Artificial Sequence
  Description of Artificial Sequence: Synthetic oligonucleotide
  Target: ANGPTL3; (-) strand; PAM type: YTN; PAM sequence: TTC
tcactaagtgccatttgagg

SEQ ID NO: 13359 - DNA, 20 bp, Artificial Sequence
  Description of Artificial Sequence: Synthetic oligonucleotide
  Target: ANGPTL3; (-) strand; PAM type: YTN; PAM sequence: TTT
ctcactaagtgccatttgag

SEQ ID NO: 13360 - DNA, 20 bp, Artificial Sequence
  Description of Artificial Sequence: Synthetic oligonucleotide
  Target: ANGPTL3; (-) strand; PAM type: YTN; PAM sequence: TTT
tctcactaagtgccatttga

SEQ ID NO: 13361 - DNA, 20 bp, Artificial Sequence
  Description of Artificial Sequence: Synthetic oligonucleotide
  Target: ANGPTL3; (-) strand; PAM type: YTN; PAM sequence: CTG
tgtattttctcactaagtgc

SEQ ID NO: 13362 - DNA, 20 bp, Artificial Sequence
  Description of Artificial Sequence: Synthetic oligonucleotide
  Target: ANGPTL3; (-) strand; PAM type: YTN; PAM sequence: TTC
tgtgtattttctcactaagt

SEQ ID NO: 13363 - DNA, 20 bp, Artificial Sequence
  Description of Artificial Sequence: Synthetic oligonucleotide
  Target: ANGPTL3; (-) strand; PAM type: YTN; PAM sequence: TTG
ccatattctgtgtattttct

SEQ ID NO: 13364 - DNA, 20 bp, Artificial Sequence
  Description of Artificial Sequence: Synthetic oligonucleotide
  Target: ANGPTL3; (-) strand; PAM type: YTN; PAM sequence: TTT
gccatattctgtgtattttc

SEQ ID NO: 13365 - DNA, 20 bp, Artificial Sequence
  Description of Artificial Sequence: Synthetic oligonucleotide
  Target: ANGPTL3; (-) strand; PAM type: YTN; PAM sequence: TTA
tgatttgccatattctgtgt

SEQ ID NO: 13366 - DNA, 20 bp, Artificial Sequence
  Description of Artificial Sequence: Synthetic oligonucleotide
  Target: ANGPTL3; (-) strand; PAM type: YTN; PAM sequence: TTA
ttatgatttgccatattctg

SEQ ID NO: 13367 - DNA, 20 bp, Artificial Sequence
  Description of Artificial Sequence: Synthetic oligonucleotide
  Target: ANGPTL3; (-) strand; PAM type: YTN; PAM sequence: TTA
ttattatgatttgccatatt

SEQ ID NO: 13368 - DNA, 20 bp, Artificial Sequence
  Description of Artificial Sequence: Synthetic oligonucleotide
  Target: ANGPTL3; (-) strand; PAM type: YTN; PAM sequence: TTT
attattatgatttgccatat

SEQ ID NO: 13369 - DNA, 20 bp, Artificial Sequence
  Description of Artificial Sequence: Synthetic oligonucleotide
  Target: ANGPTL3; (-) strand; PAM type: YTN; PAM sequence: TTT
tattattatgatttgccata

SEQ ID NO: 13370 - DNA, 20 bp, Artificial Sequence
  Description of Artificial Sequence: Synthetic oligonucleotide
  Target: ANGPTL3; (-) strand; PAM type: YTN; PAM sequence: TTT
ttattattatgatttgccat

SEQ ID NO: 13371 - DNA, 20 bp, Artificial Sequence
  Description of Artificial Sequence: Synthetic oligonucleotide
  Target: ANGPTL3; (-) strand; PAM type: YTN; PAM sequence: TTC
agaatttttattattatgat

SEQ ID NO: 13372 - DNA, 20 bp, Artificial Sequence
  Description of Artificial Sequence: Synthetic oligonucleotide
  Target: ANGPTL3; (-) strand; PAM type: YTN; PAM sequence: TTT
cagaatttttattattatga

SEQ ID NO: 13373 - DNA, 20 bp, Artificial Sequence
  Description of Artificial Sequence: Synthetic oligonucleotide
  Target: ANGPTL3; (-) strand; PAM type: YTN; PAM sequence: TTT
tcagaatttttattattatg

SEQ ID NO: 13374 - DNA, 20 bp, Artificial Sequence
  Description of Artificial Sequence: Synthetic oligonucleotide
  Target: ANGPTL3; (-) strand; PAM type: YTN; PAM sequence: TTT
ttcagaatttttattattat

SEQ ID NO: 13375 - DNA, 20 bp, Artificial Sequence
  Description of Artificial Sequence: Synthetic oligonucleotide
  Target: ANGPTL3; (-) strand; PAM type: YTN; PAM sequence: CTA
tttttcagaatttttattat

SEQ ID NO: 13376 - DNA, 20 bp, Artificial Sequence
  Description of Artificial Sequence: Synthetic oligonucleotide
  Target: ANGPTL3; (-) strand; PAM type: YTN; PAM sequence: TTA
gtactatttttcagaatttt

SEQ ID NO: 13377 - DNA, 20 bp, Artificial Sequence
  Description of Artificial Sequence: Synthetic oligonucleotide
  Target: ANGPTL3; (-) strand; PAM type: YTN; PAM sequence: TTT
agtactatttttcagaattt

SEQ ID NO: 13378 - DNA, 20 bp, Artificial Sequence
  Description of Artificial Sequence: Synthetic oligonucleotide
  Target: ANGPTL3; (-) strand; PAM type: YTN; PAM sequence: TTT
tagtactatttttcagaatt

SEQ ID NO: 13379 - DNA, 20 bp, Artificial Sequence
  Description of Artificial Sequence: Synthetic oligonucleotide
  Target: ANGPTL3; (-) strand; PAM type: YTN; PAM sequence: CTT
ttagtactatttttcagaat

SEQ ID NO: 13380 - DNA, 20 bp, Artificial Sequence
  Description of Artificial Sequence: Synthetic oligonucleotide
  Target: ANGPTL3; (-) strand; PAM type: YTN; PAM sequence: TTG
gagcttttagtactattttt

SEQ ID NO: 13381 - DNA, 20 bp, Artificial Sequence
  Description of Artificial Sequence: Synthetic oligonucleotide
  Target: ANGPTL3; (-) strand; PAM type: YTN; PAM sequence: TTT
ggagcttttagtactatttt

SEQ ID NO: 13382 - DNA, 20 bp, Artificial Sequence
  Description of Artificial Sequence: Synthetic oligonucleotide
  Target: ANGPTL3; (-) strand; PAM type: YTN; PAM sequence: TTT
tggagcttttagtactattt

SEQ ID NO: 13383 - DNA, 20 bp, Artificial Sequence
  Description of Artificial Sequence: Synthetic oligonucleotide
  Target: ANGPTL3; (-) strand; PAM type: YTN; PAM sequence: CTT
ttggagcttttagtactatt

SEQ ID NO: 13384 - DNA, 20 bp, Artificial Sequence
  Description of Artificial Sequence: Synthetic oligonucleotide
  Target: ANGPTL3; (-) strand; PAM type: YTN; PAM sequence: TTG
atgcttttggagcttttagt

SEQ ID NO: 13385 - DNA, 20 bp, Artificial Sequence
  Description of Artificial Sequence: Synthetic oligonucleotide
  Target: ANGPTL3; (-) strand; PAM type: YTN; PAM sequence: TTT
gatgcttttggagcttttag

SEQ ID NO: 13386 - DNA, 20 bp, Artificial Sequence
  Description of Artificial Sequence: Synthetic oligonucleotide
  Target: ANGPTL3; (-) strand; PAM type: YTN; PAM sequence: CTT
tgatgcttttggagctttta

SEQ ID NO: 13387 - DNA, 20 bp, Artificial Sequence
  Description of Artificial Sequence: Synthetic oligonucleotide
  Target: ANGPTL3; (-) strand; PAM type: YTN; PAM sequence: CTA
tctttgatgcttttggagct

SEQ ID NO: 13388 - DNA, 20 bp, Artificial Sequence
  Description of Artificial Sequence: Synthetic oligonucleotide
  Target: ANGPTL3; (-) strand; PAM type: YTN; PAM sequence: CTG
actatctttgatgcttttgg

SEQ ID NO: 13389 - DNA, 20 bp, Artificial Sequence
  Description of Artificial Sequence: Synthetic oligonucleotide
  Target: ANGPTL3; (-) strand; PAM type: YTN; PAM sequence: CTA
aaatcaggtaaactgactat

SEQ ID NO: 13390 - DNA, 20 bp, Artificial Sequence
  Description of Artificial Sequence: Synthetic oligonucleotide
  Target: ANGPTL3; (-) strand; PAM type: YTN; PAM sequence: TTC
actaaaatcaggtaaactga

SEQ ID NO: 13391 - DNA, 20 bp, Artificial Sequence
  Description of Artificial Sequence: Synthetic oligonucleotide
  Target: ANGPTL3; (-) strand; PAM type: YTN; PAM sequence: TTC
agtaattcactaaaatcagg

SEQ ID NO: 13392 - DNA, 20 bp, Artificial Sequence
  Description of Artificial Sequence: Synthetic oligonucleotide
  Target: ANGPTL3; (-) strand; PAM type: YTN; PAM sequence: TTT
cagtaattcactaaaatcag

SEQ ID NO: 13393 - DNA, 20 bp, Artificial Sequence
  Description of Artificial Sequence: Synthetic oligonucleotide
  Target: ANGPTL3; (-) strand; PAM type: YTN; PAM sequence: TTT
tcagtaattcactaaaatca

SEQ ID NO: 13394 - DNA, 20 bp, Artificial Sequence
  Description of Artificial Sequence: Synthetic oligonucleotide
  Target: ANGPTL3; (-) strand; PAM type: YTN; PAM sequence: TTT
ttcagtaattcactaaaatc

SEQ ID NO: 13395 - DNA, 20 bp, Artificial Sequence
  Description of Artificial Sequence: Synthetic oligonucleotide
  Target: ANGPTL3; (-) strand; PAM type: YTN; PAM sequence: TTG
atatagaaatttttcagtaa

SEQ ID NO: 13396 - DNA, 20 bp, Artificial Sequence
  Description of Artificial Sequence: Synthetic oligonucleotide
  Target: ANGPTL3; (-) strand; PAM type: YTN; PAM sequence: CTT
gatatagaaatttttcagta

SEQ ID NO: 13397 - DNA, 20 bp, Artificial Sequence
  Description of Artificial Sequence: Synthetic oligonucleotide
  Target: ANGPTL3; (-) strand; PAM type: YTN; PAM sequence: CTC
ttgatatagaaatttttcag

SEQ ID NO: 13398 - DNA, 20 bp, Artificial Sequence
  Description of Artificial Sequence: Synthetic oligonucleotide
  Target: ANGPTL3; (-) strand; PAM type: YTN; PAM sequence: TTC
aaaataaactcttgatatag

SEQ ID NO: 13399 - DNA, 20 bp, Artificial Sequence
  Description of Artificial Sequence: Synthetic oligonucleotide
  Target: ANGPTL3; (-) strand; PAM type: YTN; PAM sequence: CTG
gttcaaaataaactcttgat

SEQ ID NO: 13400 - DNA, 20 bp, Artificial Sequence
  Description of Artificial Sequence: Synthetic oligonucleotide
  Target: ANGPTL3; (-) strand; PAM type: YTN; PAM sequence: TTC
atactggttcaaaataaact

SEQ ID NO: 13401 - DNA, 20 bp, Artificial Sequence
  Description of Artificial Sequence: Synthetic oligonucleotide
  Target: ANGPTL3; (-) strand; PAM type: YTN; PAM sequence: TTC
agtaaaattcatactggttc

SEQ ID NO: 13402 - DNA, 20 bp, Artificial Sequence
  Description of Artificial Sequence: Synthetic oligonucleotide
  Target: ANGPTL3; (-) strand; PAM type: YTN; PAM sequence: TTT
cagtaaaattcatactggtt

SEQ ID NO: 13403 - DNA, 20 bp, Artificial Sequence
  Description of Artificial Sequence: Synthetic oligonucleotide
  Target: ANGPTL3; (-) strand; PAM type: YTN; PAM sequence: TTG
gtttcagtaaaattcatact

SEQ ID NO: 13404 - DNA, 20 bp, Artificial Sequence
  Description of Artificial Sequence: Synthetic oligonucleotide
  Target: ANGPTL3; (-) strand; PAM type: YTN; PAM sequence: CTT
ggtttcagtaaaattcatac

SEQ ID NO: 13405 - DNA, 20 bp, Artificial Sequence
  Description of Artificial Sequence: Synthetic oligonucleotide
  Target: ANGPTL3; (-) strand; PAM type: YTN; PAM sequence: CTC
ataatgagacatgtgtgtac

SEQ ID NO: 13406 - DNA, 20 bp, Artificial Sequence
  Description of Artificial Sequence: Synthetic oligonucleotide
  Target: ANGPTL3; (-) strand; PAM type: YTN; PAM sequence: TTA
cctcataatgagacatgtgt

SEQ ID NO: 13407 - DNA, 20 bp, Artificial Sequence
  Description of Artificial Sequence: Synthetic oligonucleotide
  Target: ANGPTL3; (-) strand; PAM type: YTN; PAM sequence: CTA
gattacctcataatgagaca

SEQ ID NO: 13408 - DNA, 20 bp, Artificial Sequence
  Description of Artificial Sequence: Synthetic oligonucleotide
  Target: ANGPTL3; (-) strand; PAM type: YTN; PAM sequence: CTA
cactagattacctcataatg

SEQ ID NO: 13409 - DNA, 20 bp, Artificial Sequence
  Description of Artificial Sequence: Synthetic oligonucleotide
  Target: ANGPTL3; (-) strand; PAM type: YTN; PAM sequence: TTA
tactacactagattacctca

SEQ ID NO: 13410 - DNA, 20 bp, Artificial Sequence
  Description of Artificial Sequence: Synthetic oligonucleotide
  Target: ANGPTL3; (-) strand; PAM type: YTN; PAM sequence: TTC
caggatgacagagtgtatgg

SEQ ID NO: 13411 - DNA, 20 bp, Artificial Sequence
  Description of Artificial Sequence: Synthetic oligonucleotide
  Target: ANGPTL3; (-) strand; PAM type: YTN; PAM sequence: CTG
attccaggatgacagagtgt

SEQ ID NO: 13412 - DNA, 20 bp, Artificial Sequence
  Description of Artificial Sequence: Synthetic oligonucleotide
  Target: ANGPTL3; (-) strand; PAM type: YTN; PAM sequence: TTA
ggaagtaaagatacaagcat

SEQ ID NO: 13413 - DNA, 20 bp, Artificial Sequence
  Description of Artificial Sequence: Synthetic oligonucleotide
  Target: ANGPTL3; (-) strand; PAM type: YTN; PAM sequence: CTA
ttaggaagtaaagatacaag

SEQ ID NO: 13414 - DNA, 20 bp, Artificial Sequence
  Description of Artificial Sequence: Synthetic oligonucleotide
  Target: ANGPTL3; (-) strand; PAM type: YTN; PAM sequence: TTA
tgctattaggaagtaaagat

SEQ ID NO: 13415 - DNA, 20 bp, Artificial Sequence
  Description of Artificial Sequence: Synthetic oligonucleotide
  Target: ANGPTL3; (-) strand; PAM type: YTN; PAM sequence: TTC
catgagttatgctattagga

SEQ ID NO: 13416 - DNA, 20 bp, Artificial Sequence
  Description of Artificial Sequence: Synthetic oligonucleotide
  Target: ANGPTL3; (-) strand; PAM type: YTN; PAM sequence: CTT
ccatgagttatgctattagg

SEQ ID NO: 13417 - DNA, 20 bp, Artificial Sequence
  Description of Artificial Sequence: Synthetic oligonucleotide
  Target: ANGPTL3; (-) strand; PAM type: YTN; PAM sequence: TTG
acttccatgagttatgctat

SEQ ID NO: 13418 - DNA, 20 bp, Artificial Sequence
  Description of Artificial Sequence: Synthetic oligonucleotide
  Target: ANGPTL3; (-) strand; PAM type: YTN; PAM sequence: TTA
gttgacttccatgagttatg

SEQ ID NO: 13419 - DNA, 20 bp, Artificial Sequence
  Description of Artificial Sequence: Synthetic oligonucleotide
  Target: ANGPTL3; (-) strand; PAM type: YTN; PAM sequence: TTA
atgaatgagttagttgactt

SEQ ID NO: 13420 - DNA, 20 bp, Artificial Sequence
  Description of Artificial Sequence: Synthetic oligonucleotide
  Target: ANGPTL3; (-) strand; PAM type: YTN; PAM sequence: CTA
aaattaatgaatgagttagt

SEQ ID NO: 13421 - DNA, 20 bp, Artificial Sequence
  Description of Artificial Sequence: Synthetic oligonucleotide
  Target: ANGPTL3; (-) strand; PAM type: YTN; PAM sequence: TTC
taaaattaatgaatgagtta

SEQ ID NO: 13422 - DNA, 20 bp, Artificial Sequence
  Description of Artificial Sequence: Synthetic oligonucleotide
  Target: ANGPTL3; (-) strand; PAM type: YTN; PAM sequence: TTT
ctaaaattaatgaatgagtt

SEQ ID NO: 13423 - DNA, 20 bp, Artificial Sequence
  Description of Artificial Sequence: Synthetic oligonucleotide
  Target: ANGPTL3; (-) strand; PAM type: YTN; PAM sequence: TTA
atgaataccatttctaaaat

SEQ ID NO: 13424 - DNA, 20 bp, Artificial Sequence
  Description of Artificial Sequence: Synthetic oligonucleotide
  Target: ANGPTL3; (-) strand; PAM type: YTN; PAM sequence: TTT
aatgaataccatttctaaaa

SEQ ID NO: 13425 - DNA, 20 bp, Artificial Sequence
  Description of Artificial Sequence: Synthetic oligonucleotide
  Target: ANGPTL3; (-) strand; PAM type: YTN; PAM sequence: TTG
tttaatgaataccatttcta

SEQ ID NO: 13426 - DNA, 20 bp, Artificial Sequence
  Description of Artificial Sequence: Synthetic oligonucleotide
  Target: ANGPTL3; (-) strand; PAM type: YTN; PAM sequence: CTC
aataagtgttgtttaatgaa

SEQ ID NO: 13427 - DNA, 20 bp, Artificial Sequence
  Description of Artificial Sequence: Synthetic oligonucleotide
  Target: ANGPTL3; (-) strand; PAM type: YTN; PAM sequence: TTA
aaggagacaaatagtagatg

SEQ ID NO: 13428 - DNA, 20 bp, Artificial Sequence
  Description of Artificial Sequence: Synthetic oligonucleotide
  Target: ANGPTL3; (-) strand; PAM type: YTN; PAM sequence: TTT
aaaggagacaaatagtagat

SEQ ID NO: 13429 - DNA, 20 bp, Artificial Sequence
  Description of Artificial Sequence: Synthetic oligonucleotide
  Target: ANGPTL3; (-) strand; PAM type: YTN; PAM sequence: TTT
taaaggagacaaatagtaga

SEQ ID NO: 13430 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaggagacaaatagtag

SEQ ID NO: 13431 - DNA, 20 bp, Artificial Sequence
  Description of Artificial Sequence: Synthetic oligonucleotide
  Target: ANGPTL3; (-) strand; PAM type: YTN; PAM sequence: TTT
tttaaaggagacaaatagta

SEQ ID NO: 13432 - DNA, 20 bp, Artificial Sequence
  Description of Artificial Sequence: Synthetic oligonucleotide
  Target: ANGPTL3; (-) strand; PAM type: YTN; PAM sequence: TTG
gaatatgttttttaaaggag

SEQ ID NO: 13433 - DNA, 20 bp, Artificial Sequence
  Description of Artificial Sequence: Synthetic oligonucleotide
  Target: ANGPTL3; (-) strand; PAM type: YTN; PAM sequence: TTT
ggaatatgttttttaaagga

SEQ ID NO: 13434 - DNA, 20 bp, Artificial Sequence
  Description of Artificial Sequence: Synthetic oligonucleotide
  Target: ANGPTL3; (-) strand; PAM type: YTN; PAM sequence: CTA
cagcagaaggtagagtatat

SEQ ID NO: 13435 - DNA, 20 bp, Artificial Sequence
  Description of Artificial Sequence: Synthetic oligonucleotide
  Target: ANGPTL3; (-) strand; PAM type: YTN; PAM sequence: TTA
tcctacagcagaaggtagag

SEQ ID NO: 13436 - DNA, 20 bp, Artificial Sequence
  Description of Artificial Sequence: Synthetic oligonucleotide
  Target: ANGPTL3; (-) strand; PAM type: YTN; PAM sequence: TTG
attatcctacagcagaaggt

SEQ ID NO: 13437 - DNA, 20 bp, Artificial Sequence
  Description of Artificial Sequence: Synthetic oligonucleotide
  Target: ANGPTL3; (-) strand; PAM type: YTN; PAM sequence: TTT
gattatcctacagcagaagg

SEQ ID NO: 13438 - DNA, 20 bp, Artificial Sequence
  Description of Artificial Sequence: Synthetic oligonucleotide
  Target: ANGPTL3; (-) strand; PAM type: YTN; PAM sequence: TTA
gtgatggggaaaaaaatcac

SEQ ID NO: 13439 - DNA, 20 bp, Artificial Sequence
  Description of Artificial Sequence: Synthetic oligonucleotide
  Target: ANGPTL3; (-) strand; PAM type: YTN; PAM sequence: CTG
ttagtgatggggaaaaaaat

SEQ ID NO: 13440 - DNA, 20 bp, Artificial Sequence
  Description of Artificial Sequence: Synthetic oligonucleotide
  Target: ANGPTL3; (-) strand; PAM type: YTN; PAM sequence: TTA
tggctgttagtgatggggaa

SEQ ID NO: 13441 - DNA, 20 bp, Artificial Sequence
  Description of Artificial Sequence: Synthetic oligonucleotide
  Target: ANGPTL3; (-) strand; PAM type: YTN; PAM sequence: TTT
atggctgttagtgatgggga

SEQ ID NO: 13442 - DNA, 20 bp, Artificial Sequence
  Description of Artificial Sequence: Synthetic oligonucleotide
  Target: ANGPTL3; (-) strand; PAM type: YTN; PAM sequence: CTC
agtagtacatacataagtgc

SEQ ID NO: 13443 - DNA, 20 bp, Artificial Sequence
  Description of Artificial Sequence: Synthetic oligonucleotide
  Target: ANGPTL3; (-) strand; PAM type: YTN; PAM sequence: TTG
ataatcactcagtagtacat

SEQ ID NO: 13444 - DNA, 20 bp, Artificial Sequence
  Description of Artificial Sequence: Synthetic oligonucleotide
  Target: ANGPTL3; (-) strand; PAM type: YTN; PAM sequence: TTT
gataatcactcagtagtaca

SEQ ID NO: 13445 - DNA, 20 bp, Artificial Sequence
  Description of Artificial Sequence: Synthetic oligonucleotide
  Target: ANGPTL3; (-) strand; PAM type: YTN; PAM sequence: CTG
tgtttgataatcactcagta

SEQ ID NO: 13446 - DNA, 20 bp, Artificial Sequence
  Description of Artificial Sequence: Synthetic oligonucleotide
  Target: ANGPTL3; (-) strand; PAM type: YTN; PAM sequence: CTG
ctgtgtttgataatcactca

SEQ ID NO: 13447 - DNA, 20 bp, Artificial Sequence
  Description of Artificial Sequence: Synthetic oligonucleotide
  Target: ANGPTL3; (-) strand; PAM type: YTN; PAM sequence: TTA
aaactgctgtgtttgataat

SEQ ID NO: 13448 - DNA, 20 bp, Artificial Sequence
  Description of Artificial Sequence: Synthetic oligonucleotide
  Target: ANGPTL3; (-) strand; PAM type: YTN; PAM sequence: TTT
aaaactgctgtgtttgataa

SEQ ID NO: 13449 - DNA, 20 bp, Artificial Sequence
  Description of Artificial Sequence: Synthetic oligonucleotide
  Target: ANGPTL3; (-) strand; PAM type: YTN; PAM sequence: TTT
taaaactgctgtgtttgata

SEQ ID NO: 13450 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaactgctgtgtttgat

SEQ ID NO: 13451 - DNA, 20 bp, Artificial Sequence
  Description of Artificial Sequence: Synthetic oligonucleotide
  Target: ANGPTL3; (-) strand; PAM type: YTN; PAM sequence: TTC
atttttaaaactgctgtgtt

SEQ ID NO: 13452 - DNA, 20 bp, Artificial Sequence
  Description of Artificial Sequence: Synthetic oligonucleotide
  Target: ANGPTL3; (-) strand; PAM type: YTN; PAM sequence: TTT
catttttaaaactgctgtgt

SEQ ID NO: 13453 - DNA, 20 bp, Artificial Sequence
  Description of Artificial Sequence: Synthetic oligonucleotide
  Target: ANGPTL3; (-) strand; PAM type: YTN; PAM sequence: TTT
tcatttttaaaactgctgtg

SEQ ID NO: 13454 - DNA, 20 bp, Artificial Sequence
  Description of Artificial Sequence: Synthetic oligonucleotide
  Target: ANGPTL3; (-) strand; PAM type: YTN; PAM sequence: CTT
ttcatttttaaaactgctgt

SEQ ID NO: 13455 - DNA, 20 bp, Artificial Sequence
  Description of Artificial Sequence: Synthetic oligonucleotide
  Target: ANGPTL3; (-) strand; PAM type: YTN; PAM sequence: TTC
ttttcatttttaaaactgct

SEQ ID NO: 13456 - DNA, 20 bp, Artificial Sequence
  Description of Artificial Sequence: Synthetic oligonucleotide
  Target: ANGPTL3; (-) strand; PAM type: YTN; PAM sequence: TTT
cttttcatttttaaaactgc

SEQ ID NO: 13457 - DNA, 20 bp, Artificial Sequence
  Description of Artificial Sequence: Synthetic oligonucleotide
  Target: ANGPTL3; (-) strand; PAM type: YTN; PAM sequence: CTT
tcttttcatttttaaaactg

SEQ ID NO: 13458 - DNA, 20 bp, Artificial Sequence
  Description of Artificial Sequence: Synthetic oligonucleotide
  Target: ANGPTL3; (-) strand; PAM type: YTN; PAM sequence: TTG
ggtcactttcttttcatttt

SEQ ID NO: 13459 - DNA, 20 bp, Artificial Sequence
  Description of Artificial Sequence: Synthetic oligonucleotide
  Target: ANGPTL3; (-) strand; PAM type: YTN; PAM sequence: TTG
ttgggtcactttcttttcat

SEQ ID NO: 13460 - DNA, 20 bp, Artificial Sequence
  Description of Artificial Sequence: Synthetic oligonucleotide
  Target: ANGPTL3; (-) strand; PAM type: YTN; PAM sequence: TTG
ataaaagggccaattgttgg

SEQ ID NO: 13461 - DNA, 20 bp, Artificial Sequence
  Description of Artificial Sequence: Synthetic oligonucleotide
  Target: ANGPTL3; (-) strand; PAM type: YTN; PAM sequence: TTT
gataaaagggccaattgttg

SEQ ID NO: 13462 - DNA, 20 bp, Artificial Sequence
  Description of Artificial Sequence: Synthetic oligonucleotide
  Target: ANGPTL3; (-) strand; PAM type: YTN; PAM sequence: CTT
tgataaaagggccaattgtt

SEQ ID NO: 13463 - DNA, 20 bp, Artificial Sequence
  Description of Artificial Sequence: Synthetic oligonucleotide
  Target: ANGPTL3; (-) strand; PAM type: YTN; PAM sequence: TTG
gactttgataaaagggccaa

SEQ ID NO: 13464 - DNA, 20 bp, Artificial Sequence
  Description of Artificial Sequence: Synthetic oligonucleotide
  Target: ANGPTL3; (-) strand; PAM type: YTN; PAM sequence: TTT
ggactttgataaaagggcca

SEQ ID NO: 13465 - DNA, 20 bp, Artificial Sequence
  Description of Artificial Sequence: Synthetic oligonucleotide
  Target: ANGPTL3; (-) strand; PAM type: YTN; PAM sequence: CTT
tggactttgataaaagggcc

SEQ ID NO: 13466 - DNA, 20 bp, Artificial Sequence
  Description of Artificial Sequence: Synthetic oligonucleotide
  Target: ANGPTL3; (-) strand; PAM type: YTN; PAM sequence: TTG
ccatgataatactttggact

SEQ ID NO: 13467 - DNA, 20 bp, Artificial Sequence
  Description of Artificial Sequence: Synthetic oligonucleotide
  Target: ANGPTL3; (-) strand; PAM type: YTN; PAM sequence: TTT
gccatgataatactttggac

SEQ ID NO: 13468 - DNA, 20 bp, Artificial Sequence
  Description of Artificial Sequence: Synthetic oligonucleotide
  Target: ANGPTL3; (-) strand; PAM type: YTN; PAM sequence: TTG
atttgccatgataatacttt

SEQ ID NO: 13469 - DNA, 20 bp, Artificial Sequence
  Description of Artificial Sequence: Synthetic oligonucleotide
  Target: ANGPTL3; (-) strand; PAM type: YTN; PAM sequence: CTA
gttgatttgccatgataata

SEQ ID NO: 13470 - DNA, 20 bp, Artificial Sequence
  Description of Artificial Sequence: Synthetic oligonucleotide
  Target: ANGPTL3; (-) strand; PAM type: YTN; PAM sequence: TTA
ccctagttgatttgccatga

SEQ ID NO: 13471 - DNA, 20 bp, Artificial Sequence
  Description of Artificial Sequence: Synthetic oligonucleotide
  Target: ANGPTL3; (-) strand; PAM type: YTN; PAM sequence: TTT
accctagttgatttgccatg

SEQ ID NO: 13472 - DNA, 20 bp, Artificial Sequence
  Description of Artificial Sequence: Synthetic oligonucleotide
  Target: ANGPTL3; (-) strand; PAM type: YTN; PAM sequence: TTT
taccctagttgatttgccat

SEQ ID NO: 13473 - DNA, 20 bp, Artificial Sequence
  Description of Artificial Sequence: Synthetic oligonucleotide
  Target: ANGPTL3; (-) strand; PAM type: YTN; PAM sequence: TTA
agtaattttaccctagttga

SEQ ID NO: 13474 - DNA, 20 bp, Artificial Sequence
  Description of Artificial Sequence: Synthetic oligonucleotide
  Target: ANGPTL3; (-) strand; PAM type: YTN; PAM sequence: CTG
tgcaccagttaagtaatttt

SEQ ID NO: 13475 - DNA, 20 bp, Artificial Sequence
  Description of Artificial Sequence: Synthetic oligonucleotide
  Target: ANGPTL3; (-) strand; PAM type: YTN; PAM sequence: TTG
aactgtgcaccagttaagta

SEQ ID NO: 13476 - DNA, 20 bp, Artificial Sequence
  Description of Artificial Sequence: Synthetic oligonucleotide
  Target: ANGPTL3; (-) strand; PAM type: YTN; PAM sequence: CTT
gaactgtgcaccagttaagt

SEQ ID NO: 13477 - DNA, 20 bp, Artificial Sequence
  Description of Artificial Sequence: Synthetic oligonucleotide
  Target: ANGPTL3; (-) strand; PAM type: YTN; PAM sequence: TTC
atgaccttgaactgtgcacc

SEQ ID NO: 13478 - DNA, 20 bp, Artificial Sequence
  Description of Artificial Sequence: Synthetic oligonucleotide
  Target: ANGPTL3; (-) strand; PAM type: YTN; PAM sequence: TTT
catgaccttgaactgtgcac

SEQ ID NO: 13479 - DNA, 20 bp, Artificial Sequence
  Description of Artificial Sequence: Synthetic oligonucleotide
  Target: ANGPTL3; (-) strand; PAM type: YTN; PAM sequence: CTT
tcatgaccttgaactgtgca

SEQ ID NO: 13480 - DNA, 20 bp, Artificial Sequence
  Description of Artificial Sequence: Synthetic oligonucleotide
  Target: ANGPTL3; (-) strand; PAM type: YTN; PAM sequence: CTA
ctttcatgaccttgaactgt

SEQ ID NO: 13481 - DNA, 20 bp, Artificial Sequence
  Description of Artificial Sequence: Synthetic oligonucleotide
  Target: ANGPTL3; (-) strand; PAM type: YTN; PAM sequence: TTA
gtgctactttcatgaccttg

SEQ ID NO: 13482 - DNA, 20 bp, Artificial Sequence
  Description of Artificial Sequence: Synthetic oligonucleotide
  Target: ANGPTL3; (-) strand; PAM type: YTN; PAM sequence: TTG
ttagtgctactttcatgacc

SEQ ID NO: 13483 - DNA, 20 bp, Artificial Sequence
  Description of Artificial Sequence: Synthetic oligonucleotide
  Target: ANGPTL3; (-) strand; PAM type: YTN; PAM sequence: TTA
taatagaggattgttagtgc

SEQ ID NO: 13484 - DNA, 20 bp, Artificial Sequence
  Description of Artificial Sequence: Synthetic oligonucleotide
  Target: ANGPTL3; (-) strand; PAM type: YTN; PAM sequence: TTA
agggttataatagaggattg

SEQ ID NO: 13485 - DNA, 20 bp, Artificial Sequence
  Description of Artificial Sequence: Synthetic oligonucleotide
  Target: ANGPTL3; (-) strand; PAM type: YTN; PAM sequence: TTA
ttaagggttataatagagga

SEQ ID NO: 13486 - DNA, 20 bp, Artificial Sequence
  Description of Artificial Sequence: Synthetic oligonucleotide
  Target: ANGPTL3; (-) strand; PAM type: YTN; PAM sequence: TTT
attaagggttataatagagg

SEQ ID NO: 13487 - DNA, 20 bp, Artificial Sequence
  Description of Artificial Sequence: Synthetic oligonucleotide
  Target: ANGPTL3; (-) strand; PAM type: YTN; PAM sequence: TTT
tattaagggttataatagag

SEQ ID NO: 13488 - DNA, 20 bp, Artificial Sequence
  Description of Artificial Sequence: Synthetic oligonucleotide
  Target: ANGPTL3; (-) strand; PAM type: YTN; PAM sequence: CTC
attttattaagggttataat

SEQ ID NO: 13489 - DNA, 20 bp, Artificial Sequence
  Description of Artificial Sequence: Synthetic oligonucleotide
  Target: ANGPTL3; (-) strand; PAM type: YTN; PAM sequence: TTA
aaacctcattttattaaggg

SEQ ID NO: 13490 - DNA, 20 bp, Artificial Sequence
  Description of Artificial Sequence: Synthetic oligonucleotide
  Target: ANGPTL3; (-) strand; PAM type: YTN; PAM sequence: CTA
aaatgtcattaaaacctcat

SEQ ID NO: 13491 - DNA, 20 bp, Artificial Sequence
  Description of Artificial Sequence: Synthetic oligonucleotide
  Target: ANGPTL3; (-) strand; PAM type: YTN; PAM sequence: TTC
ctaaaatgtcattaaaacct

SEQ ID NO: 13492 - DNA, 20 bp, Artificial Sequence
  Description of Artificial Sequence: Synthetic oligonucleotide
  Target: ANGPTL3; (-) strand; PAM type: YTN; PAM sequence: TTT
cctaaaatgtcattaaaacc

SEQ ID NO: 13493 - DNA, 20 bp, Artificial Sequence
  Description of Artificial Sequence: Synthetic oligonucleotide
  Target: ANGPTL3; (-) strand; PAM type: YTN; PAM sequence: TTA
tatttcctaaaatgtcatta

SEQ ID NO: 13494 - DNA, 20 bp, Artificial Sequence
  Description of Artificial Sequence: Synthetic oligonucleotide
  Target: ANGPTL3; (-) strand; PAM type: YTN; PAM sequence: TTT
atatttcctaaaatgtcatt

SEQ ID NO: 13495 - DNA, 20 bp, Artificial Sequence
  Description of Artificial Sequence: Synthetic oligonucleotide
  Target: ANGPTL3; (-) strand; PAM type: YTN; PAM sequence: TTT
tatatttcctaaaatgtcat

SEQ ID NO: 13496 - DNA, 20 bp, Artificial Sequence
  Description of Artificial Sequence: Synthetic oligonucleotide
  Target: ANGPTL3; (-) strand; PAM type: YTN; PAM sequence: TTA
ttttatatttcctaaaatgt

SEQ ID NO: 13497 - DNA, 20 bp, Artificial Sequence
  Description of Artificial Sequence: Synthetic oligonucleotide
  Target: ANGPTL3; (-) strand; PAM type: YTN; PAM sequence: TTT
attttatatttcctaaaatg

SEQ ID NO: 13498 - DNA, 20 bp, Artificial Sequence
  Description of Artificial Sequence: Synthetic oligonucleotide
  Target: ANGPTL3; (-) strand; PAM type: YTN; PAM sequence: TTA
agtttattttatatttccta

SEQ ID NO: 13499 - DNA, 20 bp, Artificial Sequence
  Description of Artificial Sequence: Synthetic oligonucleotide
  Target: ANGPTL3; (-) strand; PAM type: YTN; PAM sequence: CTT
aagtttattttatatttcct

SEQ ID NO: 13500 - DNA, 20 bp, Artificial Sequence
  Description of Artificial Sequence: Synthetic oligonucleotide
  Target: ANGPTL3; (-) strand; PAM type: YTN; PAM sequence: TTC
ttaagtttattttatatttc

SEQ ID NO: 13501 - DNA, 20 bp, Artificial Sequence
  Description of Artificial Sequence: Synthetic oligonucleotide
  Target: ANGPTL3; (-) strand; PAM type: YTN; PAM sequence: TTA
gatagaattcttaagtttat

SEQ ID NO: 13502 - DNA, 20 bp, Artificial Sequence
  Description of Artificial Sequence: Synthetic oligonucleotide
  Target: ANGPTL3; (-) strand; PAM type: YTN; PAM sequence: TTT
agatagaattcttaagttta

SEQ ID NO: 13503 - DNA, 20 bp, Artificial Sequence
  Description of Artificial Sequence: Synthetic oligonucleotide
  Target: ANGPTL3; (-) strand; PAM type: YTN; PAM sequence: TTT
tagatagaattcttaagttt

SEQ ID NO: 13504 - DNA, 20 bp, Artificial Sequence
  Description of Artificial Sequence: Synthetic oligonucleotide
  Target: ANGPTL3; (-) strand; PAM type: YTN; PAM sequence: TTG
tattttagatagaattctta

SEQ ID NO: 13505 - DNA, 20 bp, Artificial Sequence
  Description of Artificial Sequence: Synthetic oligonucleotide
  Target: ANGPTL3; (-) strand; PAM type: YTN; PAM sequence: TTT
gtattttagatagaattctt

SEQ ID NO: 13506 - DNA, 20 bp, Artificial Sequence
  Description of Artificial Sequence: Synthetic oligonucleotide
  Target: ANGPTL3; (-) strand; PAM type: YTN; PAM sequence: CTT
tgtattttagatagaattct

SEQ ID NO: 13507 - DNA, 20 bp, Artificial Sequence
  Description of Artificial Sequence: Synthetic oligonucleotide
  Target: ANGPTL3; (-) strand; PAM type: YTN; PAM sequence: TTA
ggaaaaacagcctttgtatt

SEQ ID NO: 13508 - DNA, 20 bp, Artificial Sequence
  Description of Artificial Sequence: Synthetic oligonucleotide
  Target: ANGPTL3; (-) strand; PAM type: YTN; PAM sequence: TTT
aggaaaaacagcctttgtat

SEQ ID NO: 13509 - DNA, 20 bp, Artificial Sequence
  Description of Artificial Sequence: Synthetic oligonucleotide
  Target: ANGPTL3; (-) strand; PAM type: YTN; PAM sequence: CTA
aacatgaatttaggaaaaac

SEQ ID NO: 13510 - DNA, 20 bp, Artificial Sequence
  Description of Artificial Sequence: Synthetic oligonucleotide
  Target: ANGPTL3; (-) strand; PAM type: YTN; PAM sequence: TTA
ggactaaacatgaatttagg

SEQ ID NO: 13511 - DNA, 20 bp, Artificial Sequence
  Description of Artificial Sequence: Synthetic oligonucleotide
  Target: ANGPTL3; (-) strand; PAM type: YTN; PAM sequence: CTT
aggactaaacatgaatttag

SEQ ID NO: 13512 - DNA, 20 bp, Artificial Sequence
  Description of Artificial Sequence: Synthetic oligonucleotide
  Target: ANGPTL3; (-) strand; PAM type: YTN; PAM sequence: TTC
ttaggactaaacatgaattt

SEQ ID NO: 13513 - DNA, 20 bp, Artificial Sequence
  Description of Artificial Sequence: Synthetic oligonucleotide
  Target: ANGPTL3; (-) strand; PAM type: YTN; PAM sequence: CTG
ttcttaggactaaacatgaa

SEQ ID NO: 13514 - DNA, 20 bp, Artificial Sequence
  Description of Artificial Sequence: Synthetic oligonucleotide
  Target: ANGPTL3; (-) strand; PAM type: YTN; PAM sequence: TTA
gatgtatgactgttcttagg

SEQ ID NO: 13515 - DNA, 20 bp, Artificial Sequence
  Description of Artificial Sequence: Synthetic oligonucleotide
  Target: ANGPTL3; (-) strand; PAM type: YTN; PAM sequence: TTA
ttagatgtatgactgttctt

SEQ ID NO: 13516 - DNA, 20 bp, Artificial Sequence
  Description of Artificial Sequence: Synthetic oligonucleotide
  Target: ANGPTL3; (-) strand; PAM type: YTN; PAM sequence: TTT
attagatgtatgactgttct

SEQ ID NO: 13517 - DNA, 20 bp, Artificial Sequence
  Description of Artificial Sequence: Synthetic oligonucleotide
  Target: ANGPTL3; (-) strand; PAM type: YTN; PAM sequence: TTT
tattagatgtatgactgttc

SEQ ID NO: 13518 - DNA, 20 bp, Artificial Sequence
  Description of Artificial Sequence: Synthetic oligonucleotide
  Target: ANGPTL3; (-) strand; PAM type: YTN; PAM sequence: TTA
tatacccagtcattttatta

SEQ ID NO: 13519 - DNA, 20 bp, Artificial Sequence
  Description of Artificial Sequence: Synthetic oligonucleotide
  Target: ANGPTL3; (-) strand; PAM type: YTN; PAM sequence: TTC
aaattatatacccagtcatt

SEQ ID NO: 13520 - DNA, 20 bp, Artificial Sequence
  Description of Artificial Sequence: Synthetic oligonucleotide
  Target: ANGPTL3; (-) strand; PAM type: YTN; PAM sequence: TTT
caaattatatacccagtcat

SEQ ID NO: 13521 - DNA, 20 bp, Artificial Sequence
  Description of Artificial Sequence: Synthetic oligonucleotide
  Target: ANGPTL3; (-) strand; PAM type: YTN; PAM sequence: CTT
tcaaattatatacccagtca

SEQ ID NO: 13522 - DNA, 20 bp, Artificial Sequence
  Description of Artificial Sequence: Synthetic oligonucleotide
  Target: ANGPTL3; (-) strand; PAM type: YTN; PAM sequence: CTC
tttcaaattatatacccagt

SEQ ID NO: 13523 - DNA, 20 bp, Artificial Sequence
  Description of Artificial Sequence: Synthetic oligonucleotide
  Target: ANGPTL3; (-) strand; PAM type: YTN; PAM sequence: TTG
ctctttcaaattatataccc

SEQ ID NO: 13524 - DNA, 20 bp, Artificial Sequence
  Description of Artificial Sequence: Synthetic oligonucleotide
  Target: ANGPTL3; (-) strand; PAM type: YTN; PAM sequence: TTA
ttgctctttcaaattatata

SEQ ID NO: 13525 - DNA, 20 bp, Artificial Sequence
  Description of Artificial Sequence: Synthetic oligonucleotide
  Target: ANGPTL3; (-) strand; PAM type: YTN; PAM sequence: TTT
attgctctttcaaattatat

SEQ ID NO: 13526 - DNA, 20 bp, Artificial Sequence
  Description of Artificial Sequence: Synthetic oligonucleotide
  Target: ANGPTL3; (-) strand; PAM type: YTN; PAM sequence: TTC
aaggtagtaatttattgctc

SEQ ID NO: 13527 - DNA, 20 bp, Artificial Sequence
  Description of Artificial Sequence: Synthetic oligonucleotide
  Target: ANGPTL3; (-) strand; PAM type: YTN; PAM sequence: CTT
caaggtagtaatttattgct

SEQ ID NO: 13528 - DNA, 20 bp, Artificial Sequence
  Description of Artificial Sequence: Synthetic oligonucleotide
  Target: ANGPTL3; (-) strand; PAM type: YTN; PAM sequence: TTA
catcttcaaggtagtaattt

SEQ ID NO: 13529 - DNA, 20 bp, Artificial Sequence
  Description of Artificial Sequence: Synthetic oligonucleotide
  Target: ANGPTL3; (-) strand; PAM type: YTN; PAM sequence: CTT
acatcttcaaggtagtaatt

SEQ ID NO: 13530 - DNA, 20 bp, Artificial Sequence
  Description of Artificial Sequence: Synthetic oligonucleotide
  Target: ANGPTL3; (-) strand; PAM type: YTN; PAM sequence: CTA
caaccttacatcttcaaggt

SEQ ID NO: 13531 - DNA, 20 bp, Artificial Sequence
  Description of Artificial Sequence: Synthetic oligonucleotide
  Target: ANGPTL3; (-) strand; PAM type: YTN; PAM sequence: TTA
agataaatagctacaacctt

SEQ ID NO: 13532 - DNA, 20 bp, Artificial Sequence
  Description of Artificial Sequence: Synthetic oligonucleotide
  Target: ANGPTL3; (-) strand; PAM type: YTN; PAM sequence: TTT
aagataaatagctacaacct

SEQ ID NO: 13533 - DNA, 20 bp, Artificial Sequence
  Description of Artificial Sequence: Synthetic oligonucleotide
  Target: ANGPTL3; (-) strand; PAM type: YTN; PAM sequence: TTT
taagataaatagctacaacc

SEQ ID NO: 13534 - DNA, 20 bp, Artificial Sequence
  Description of Artificial Sequence: Synthetic oligonucleotide
  Target: ANGPTL3; (-) strand; PAM type: YTN; PAM sequence: CTG
tgtattttaagataaatagc

SEQ ID NO: 13535 - DNA, 20 bp, Artificial Sequence
  Description of Artificial Sequence: Synthetic oligonucleotide
  Target: ANGPTL3; (-) strand; PAM type: YTN; PAM sequence: TTG
actgtgtattttaagataaa

SEQ ID NO: 13536 - DNA, 20 bp, Artificial Sequence
  Description of Artificial Sequence: Synthetic oligonucleotide
  Target: ANGPTL3; (-) strand; PAM type: YTN; PAM sequence: TTT
gactgtgtattttaagataa

SEQ ID NO: 13537 - DNA, 20 bp, Artificial Sequence
  Description of Artificial Sequence: Synthetic oligonucleotide
  Target: ANGPTL3; (-) strand; PAM type: YTN; PAM sequence: CTG
aggtttgactgtgtatttta

SEQ ID NO: 13538 - DNA, 20 bp, Artificial Sequence
  Description of Artificial Sequence: Synthetic oligonucleotide
  Target: ANGPTL3; (-) strand; PAM type: YTN; PAM sequence: TTG
ggtgtggaaactgaggtttg

SEQ ID NO: 13539 - DNA, 20 bp, Artificial Sequence
  Description of Artificial Sequence: Synthetic oligonucleotide
  Target: ANGPTL3; (-) strand; PAM type: YTN; PAM sequence: CTA
ttgggtgtggaaactgaggt

SEQ ID NO: 13540 - DNA, 20 bp, Artificial Sequence
  Description of Artificial Sequence: Synthetic oligonucleotide
  Target: ANGPTL3; (-) strand; PAM type: YTN; PAM sequence: TTC
ccatctattgggtgtggaaa

SEQ ID NO: 13541 - DNA, 20 bp, Artificial Sequence
  Description of Artificial Sequence: Synthetic oligonucleotide
  Target: ANGPTL3; (-) strand; PAM type: YTN; PAM sequence: TTA
ttcccatctattgggtgtgg

SEQ ID NO: 13542 - DNA, 20 bp, Artificial Sequence
  Description of Artificial Sequence: Synthetic oligonucleotide
  Target: ANGPTL3; (-) strand; PAM type: YTN; PAM sequence: TTA
ttattcccatctattgggtg

SEQ ID NO: 13543 - DNA, 20 bp, Artificial Sequence
  Description of Artificial Sequence: Synthetic oligonucleotide
  Target: ANGPTL3; (-) strand; PAM type: YTN; PAM sequence: TTG
acaggattattattcccatc

SEQ ID NO: 13544 - DNA, 20 bp, Artificial Sequence
  Description of Artificial Sequence: Synthetic oligonucleotide
  Target: ANGPTL3; (-) strand; PAM type: YTN; PAM sequence: TTT
gacaggattattattcccat

SEQ ID NO: 13545 - DNA, 20 bp, Artificial Sequence
  Description of Artificial Sequence: Synthetic oligonucleotide
  Target: ANGPTL3; (-) strand; PAM type: YTN; PAM sequence: TTA
atagatttgacaggattatt

SEQ ID NO: 13546 - DNA, 20 bp, Artificial Sequence
  Description of Artificial Sequence: Synthetic oligonucleotide
  Target: ANGPTL3; (-) strand; PAM type: YTN; PAM sequence: TTA
caatcccatgaagtattaat

SEQ ID NO: 13547 - DNA, 20 bp, Artificial Sequence
  Description of Artificial Sequence: Synthetic oligonucleotide
  Target: ANGPTL3; (-) strand; PAM type: YTN; PAM sequence: TTG
atgattacaatcccatgaag

SEQ ID NO: 13548 - DNA, 20 bp, Artificial Sequence
  Description of Artificial Sequence: Synthetic oligonucleotide
  Target: ANGPTL3; (-) strand; PAM type: YTN; PAM sequence: CTT
gatgattacaatcccatgaa

SEQ ID NO: 13549 - DNA, 20 bp, Artificial Sequence
  Description of Artificial Sequence: Synthetic oligonucleotide
  Target: ANGPTL3; (-) strand; PAM type: YTN; PAM sequence: CTG
gcttgatgattacaatccca

SEQ ID NO: 13550 - DNA, 20 bp, Artificial Sequence
  Description of Artificial Sequence: Synthetic oligonucleotide
  Target: ANGPTL3; (-) strand; PAM type: YTN; PAM sequence: TTA
tctggcttgatgattacaat

SEQ ID NO: 13551 - DNA, 20 bp, Artificial Sequence
  Description of Artificial Sequence: Synthetic oligonucleotide
  Target: ANGPTL3; (-) strand; PAM type: YTN; PAM sequence: TTC
aaatacattatctggcttga

SEQ ID NO: 13552 - DNA, 20 bp, Artificial Sequence
  Description of Artificial Sequence: Synthetic oligonucleotide
  Target: ANGPTL3; (-) strand; PAM type: YTN; PAM sequence: CTA
ttcaaatacattatctggct

SEQ ID NO: 13553 - DNA, 20 bp, Artificial Sequence
  Description of Artificial Sequence: Synthetic oligonucleotide
  Target: ANGPTL3; (-) strand; PAM type: YTN; PAM sequence: TTC
ataaagctattcaaatacat

SEQ ID NO: 13554 - DNA, 20 bp, Artificial Sequence
  Description of Artificial Sequence: Synthetic oligonucleotide
  Target: ANGPTL3; (-) strand; PAM type: YTN; PAM sequence: TTA
tagttcataaagctattcaa

SEQ ID NO: 13555 - DNA, 20 bp, Artificial Sequence
  Description of Artificial Sequence: Synthetic oligonucleotide
  Target: ANGPTL3; (-) strand; PAM type: YTN; PAM sequence: TTT
atagttcataaagctattca

SEQ ID NO: 13556 - DNA, 20 bp, Artificial Sequence
  Description of Artificial Sequence: Synthetic oligonucleotide
  Target: ANGPTL3; (-) strand; PAM type: YTN; PAM sequence: CTT
tatagttcataaagctattc

SEQ ID NO: 13557 - DNA, 20 bp, Artificial Sequence
  Description of Artificial Sequence: Synthetic oligonucleotide
  Target: ANGPTL3; (-) strand; PAM type: YTN; PAM sequence: TTA
gaactttatagttcataaag

SEQ ID NO: 13558 - DNA, 20 bp, Artificial Sequence
  Description of Artificial Sequence: Synthetic oligonucleotide
  Target: ANGPTL3; (-) strand; PAM type: YTN; PAM sequence: TTT
agaactttatagttcataaa

SEQ ID NO: 13559 - DNA, 20 bp, Artificial Sequence
  Description of Artificial Sequence: Synthetic oligonucleotide
  Target: ANGPTL3; (-) strand; PAM type: YTN; PAM sequence: TTG
tttagaactttatagttcat

SEQ ID NO: 13560 - DNA, 20 bp, Artificial Sequence
  Description of Artificial Sequence: Synthetic oligonucleotide
  Target: ANGPTL3; (-) strand; PAM type: YTN; PAM sequence: TTT
gtttagaactttatagttca

SEQ ID NO: 13561 - DNA, 20 bp, Artificial Sequence
  Description of Artificial Sequence: Synthetic oligonucleotide
  Target: ANGPTL3; (-) strand; PAM type: YTN; PAM sequence: TTA
aaaagtatatacatttgttt

SEQ ID NO: 13562 - DNA, 20 bp, Artificial Sequence
  Description of Artificial Sequence: Synthetic oligonucleotide
  Target: ANGPTL3; (-) strand; PAM type: YTN; PAM sequence: TTT
aaaaagtatatacatttgtt

SEQ ID NO: 13563 - DNA, 20 bp, Artificial Sequence
  Description of Artificial Sequence: Synthetic oligonucleotide
  Target: ANGPTL3; (-) strand; PAM type: YTN; PAM sequence: TTT
taaaaagtatatacatttgt

SEQ ID NO: 13564 - DNA, 20 bp, Artificial Sequence
  Description of Artificial Sequence: Synthetic oligonucleotide
  Target: ANGPTL3; (-) strand; PAM type: YTN; PAM sequence: TTT
ttaaaaagtatatacatttg

SEQ ID NO: 13565 - DNA, 20 bp, Artificial Sequence
  Description of Artificial Sequence: Synthetic oligonucleotide
  Target: ANGPTL3; (-) strand; PAM type: YTN; PAM sequence: CTG
tttttaaaaagtatatacat

SEQ ID NO: 13566 - DNA, 20 bp, Artificial Sequence
  Description of Artificial Sequence: Synthetic oligonucleotide
  Target: ANGPTL3; (-) strand; PAM type: YTN; PAM sequence: TTA
aaggaatgtgaaaaatgaca

SEQ ID NO: 13567 - DNA, 20 bp, Artificial Sequence
  Description of Artificial Sequence: Synthetic oligonucleotide
  Target: ANGPTL3; (-) strand; PAM type: YTN; PAM sequence: CTT
aaaggaatgtgaaaaatgac

SEQ ID NO: 13568 - DNA, 20 bp, Artificial Sequence
  Description of Artificial Sequence: Synthetic oligonucleotide
  Target: ANGPTL3; (-) strand; PAM type: YTN; PAM sequence: TTA
cttaaaggaatgtgaaaaat

SEQ ID NO: 13569 - DNA, 20 bp, Artificial Sequence
  Description of Artificial Sequence: Synthetic oligonucleotide
  Target: ANGPTL3; (-) strand; PAM type: YTN; PAM sequence: TTT
acttaaaggaatgtgaaaaa

SEQ ID NO: 13570 - DNA, 20 bp, Artificial Sequence
  Description of Artificial Sequence: Synthetic oligonucleotide
  Target: ANGPTL3; (-) strand; PAM type: YTN; PAM sequence: TTA
tttacttaaaggaatgtgaa

SEQ ID NO: 13571 - DNA, 20 bp, Artificial Sequence
  Description of Artificial Sequence: Synthetic oligonucleotide
  Target: ANGPTL3; (-) strand; PAM type: YTN; PAM sequence: TTG
tagagattatttacttaaag

SEQ ID NO: 13572 - DNA, 20 bp, Artificial Sequence
  Description of Artificial Sequence: Synthetic oligonucleotide
  Target: ANGPTL3; (-) strand; PAM type: YTN; PAM sequence: TTT
gtagagattatttacttaaa

SEQ ID NO: 13573 - DNA, 20 bp, Artificial Sequence
  Description of Artificial Sequence: Synthetic oligonucleotide
  Target: ANGPTL3; (-) strand; PAM type: YTN; PAM sequence: TTA
ggaagcgtttgtagagatta

SEQ ID NO: 13574 - DNA, 20 bp, Artificial Sequence
  Description of Artificial Sequence: Synthetic oligonucleotide
  Target: ANGPTL3; (-) strand; PAM type: YTN; PAM sequence: TTC
agttaggaagcgtttgtaga

SEQ ID NO: 13575 - DNA, 20 bp, Artificial Sequence
  Description of Artificial Sequence: Synthetic oligonucleotide
  Target: ANGPTL3; (-) strand; PAM type: YTN; PAM sequence: TTA
taatatgttcagttaggaag

SEQ ID NO: 13576 - DNA, 20 bp, Artificial Sequence
  Description of Artificial Sequence: Synthetic oligonucleotide
  Target: ANGPTL3; (-) strand; PAM type: YTN; PAM sequence: CTG
agaattataatatgttcagt

SEQ ID NO: 13577 - DNA, 20 bp, Artificial Sequence
  Description of Artificial Sequence: Synthetic oligonucleotide
  Target: ANGPTL3; (-) strand; PAM type: YTN; PAM sequence: CTG
tcctgagaattataatatgt

SEQ ID NO: 13578 - DNA, 20 bp, Artificial Sequence
  Description of Artificial Sequence: Synthetic oligonucleotide
  Target: ANGPTL3; (-) strand; PAM type: YTN; PAM sequence: TTC
tgtcctgagaattataatat

SEQ ID NO: 13579 - DNA, 20 bp, Artificial Sequence
  Description of Artificial Sequence: Synthetic oligonucleotide
  Target: ANGPTL3; (-) strand; PAM type: YTN; PAM sequence: CTT
ctgtcctgagaattataata

SEQ ID NO: 13580 - DNA, 20 bp, Artificial Sequence
  Description of Artificial Sequence: Synthetic oligonucleotide
  Target: ANGPTL3; (-) strand; PAM type: YTN; PAM sequence: TTC
ttctgtcctgagaattataa

SEQ ID NO: 13581 - DNA, 20 bp, Artificial Sequence
  Description of Artificial Sequence: Synthetic oligonucleotide
  Target: ANGPTL3; (-) strand; PAM type: YTN; PAM sequence: TTG
ttcttctgtcctgagaatta

SEQ ID NO: 13582 - DNA, 20 bp, Artificial Sequence
  Description of Artificial Sequence: Synthetic oligonucleotide
  Target: ANGPTL3; (-) strand; PAM type: YTN; PAM sequence: TTT
gttcttctgtcctgagaatt

SEQ ID NO: 13583 - DNA, 20 bp, Artificial Sequence
  Description of Artificial Sequence: Synthetic oligonucleotide
  Target: ANGPTL3; (-) strand; PAM type: YTN; PAM sequence: TTT
tgttcttctgtcctgagaat

SEQ ID NO: 13584 - DNA, 20 bp, Artificial Sequence
  Description of Artificial Sequence: Synthetic oligonucleotide
  Target: ANGPTL3; (-) strand; PAM type: YTN; PAM sequence: CTG
agaagggcagttttgttctt

SEQ ID NO: 13585 - DNA, 20 bp, Artificial Sequence
  Description of Artificial Sequence: Synthetic oligonucleotide
  Target: ANGPTL3; (-) strand; PAM type: YTN; PAM sequence: CTC
tgagaagggcagttttgttc

SEQ ID NO: 13586 - DNA, 20 bp, Artificial Sequence
  Description of Artificial Sequence: Synthetic oligonucleotide
  Target: ANGPTL3; (-) strand; PAM type: YTN; PAM sequence: TTC
cagaaacagatgcaaactct

SEQ ID NO: 13587 - DNA, 20 bp, Artificial Sequence
  Description of Artificial Sequence: Synthetic oligonucleotide
  Target: ANGPTL3; (-) strand; PAM type: YTN; PAM sequence: TTG
tgaagggaaggagtaaagtt

SEQ ID NO: 13588 - DNA, 20 bp, Artificial Sequence
  Description of Artificial Sequence: Synthetic oligonucleotide
  Target: ANGPTL3; (-) strand; PAM type: YTN; PAM sequence: TTA
gattgtgaagggaaggagta

SEQ ID NO: 13589 - DNA, 20 bp, Artificial Sequence
  Description of Artificial Sequence: Synthetic oligonucleotide
  Target: ANGPTL3; (-) strand; PAM type: YTN; PAM sequence: CTT
agattgtgaagggaaggagt

SEQ ID NO: 13590 - DNA, 20 bp, Artificial Sequence
  Description of Artificial Sequence: Synthetic oligonucleotide
  Target: ANGPTL3; (-) strand; PAM type: YTN; PAM sequence: TTA
tcttagattgtgaagggaag

SEQ ID NO: 13591 - DNA, 20 bp, Artificial Sequence
  Description of Artificial Sequence: Synthetic oligonucleotide
  Target: ANGPTL3; (-) strand; PAM type: YTN; PAM sequence: CTG
aaggtgatggagtgttatct

SEQ ID NO: 13592 - DNA, 20 bp, Artificial Sequence
  Description of Artificial Sequence: Synthetic oligonucleotide
  Target: ANGPTL3; (-) strand; PAM type: YTN; PAM sequence: TTG
catctgaaggtgatggagtg

SEQ ID NO: 13593 - DNA, 20 bp, Artificial Sequence
  Description of Artificial Sequence: Synthetic oligonucleotide
  Target: ANGPTL3; (-) strand; PAM type: YTN; PAM sequence: CTT
gcatctgaaggtgatggagt

SEQ ID NO: 13594 - DNA, 20 bp, Artificial Sequence
  Description of Artificial Sequence: Synthetic oligonucleotide
  Target: ANGPTL3; (-) strand; PAM type: YTN; PAM sequence: TTA
ggggcttgcatctgaaggtg

SEQ ID NO: 13595 - DNA, 20 bp, Artificial Sequence
  Description of Artificial Sequence: Synthetic oligonucleotide
  Target: ANGPTL3; (-) strand; PAM type: YTN; PAM sequence: TTA
gttaggggcttgcatctgaa

SEQ ID NO: 13596 - DNA, 20 bp, Artificial Sequence
  Description of Artificial Sequence: Synthetic oligonucleotide
  Target: ANGPTL3; (-) strand; PAM type: YTN; PAM sequence: TTT
agttaggggcttgcatctga

SEQ ID NO: 13597 - DNA, 20 bp, Artificial Sequence
  Description of Artificial Sequence: Synthetic oligonucleotide
  Target: ANGPTL3; (-) strand; PAM type: YTN; PAM sequence: TTT
tagttaggggcttgcatctg

SEQ ID NO: 13598 - DNA, 20 bp, Artificial Sequence
  Description of Artificial Sequence: Synthetic oligonucleotide
  Target: ANGPTL3; (-) strand; PAM type: YTN; PAM sequence: TTT
ttagttaggggcttgcatct

SEQ ID NO: 13599 - DNA, 20 bp, Artificial Sequence
  Description of Artificial Sequence: Synthetic oligonucleotide
  Target: ANGPTL3; (-) strand; PAM type: YTN; PAM sequence: TTA
acatagccacccagaagttt

SEQ ID NO: 13600 - DNA, 20 bp, Artificial Sequence
  Description of Artificial Sequence: Synthetic oligonucleotide
  Target: ANGPTL3; (-) strand; PAM type: YTN; PAM sequence: TTT
aacatagccacccagaagtt

SEQ ID NO: 13601 - DNA, 20 bp, Artificial Sequence
  Description of Artificial Sequence: Synthetic oligonucleotide
  Target: ANGPTL3; (-) strand; PAM type: YTN; PAM sequence: TTT
taacatagccacccagaagt

SEQ ID NO: 13602 - DNA, 20 bp, Artificial Sequence
  Description of Artificial Sequence: Synthetic oligonucleotide
  Target: ANGPTL3; (-) strand; PAM type: YTN; PAM sequence: CTA
acattttaacatagccaccc

SEQ ID NO: 13603 - DNA, 20 bp, Artificial Sequence
  Description of Artificial Sequence: Synthetic oligonucleotide
  Target: ANGPTL3; (-) strand; PAM type: YTN; PAM sequence: TTC
ctaacattttaacatagcca

SEQ ID NO: 13604 - DNA, 20 bp, Artificial Sequence
  Description of Artificial Sequence: Synthetic oligonucleotide
  Target: ANGPTL3; (-) strand; PAM type: YTN; PAM sequence: TTT
cctaacattttaacatagcc

SEQ ID NO: 13605 - DNA, 20 bp, Artificial Sequence
  Description of Artificial Sequence: Synthetic oligonucleotide
  Target: ANGPTL3; (-) strand; PAM type: YTN; PAM sequence: CTA
tttcctaacattttaacata

SEQ ID NO: 13606 - DNA, 20 bp, Artificial Sequence
  Description of Artificial Sequence: Synthetic oligonucleotide
  Target: ANGPTL3; (-) strand; PAM type: YTN; PAM sequence: CTC
tatttcctaacattttaaca

SEQ ID NO: 13607 - DNA, 20 bp, Artificial Sequence
  Description of Artificial Sequence: Synthetic oligonucleotide
  Target: ANGPTL3; (-) strand; PAM type: YTN; PAM sequence: CTG
agtcaagagctctatttcct

SEQ ID NO: 13608 - DNA, 20 bp, Artificial Sequence
  Description of Artificial Sequence: Synthetic oligonucleotide
  Target: ANGPTL3; (-) strand; PAM type: YTN; PAM sequence: TTC
tgagtcaagagctctatttc

SEQ ID NO: 13609 - DNA, 20 bp, Artificial Sequence
  Description of Artificial Sequence: Synthetic oligonucleotide
  Target: ANGPTL3; (-) strand; PAM type: YTN; PAM sequence: CTC
gaaaaaaaaaagaattctga

SEQ ID NO: 13610 - DNA, 20 bp, Artificial Sequence
  Description of Artificial Sequence: Synthetic oligonucleotide
  Target: ANGPTL3; (-) strand; PAM type: YTN; PAM sequence: CTC
catctcgaaaaaaaaaagaa

SEQ ID NO: 13611 - DNA, 20 bp, Artificial Sequence
  Description of Artificial Sequence: Synthetic oligonucleotide
  Target: ANGPTL3; (-) strand; PAM type: YTN; PAM sequence: CTG
ggtgacagagcgagactcca

SEQ ID NO: 13612 - DNA, 20 bp, Artificial Sequence
  Description of Artificial Sequence: Synthetic oligonucleotide
  Target: ANGPTL3; (-) strand; PAM type: YTN; PAM sequence: CTC
cagcctgggtgacagagcga

SEQ ID NO: 13613 - DNA, 20 bp, Artificial Sequence
  Description of Artificial Sequence: Synthetic oligonucleotide
  Target: ANGPTL3; (-) strand; PAM type: YTN; PAM sequence: CTG
cactccagcctgggtgacag

SEQ ID NO: 13614 - DNA, 20 bp, Artificial Sequence
  Description of Artificial Sequence: Synthetic oligonucleotide
  Target: ANGPTL3; (-) strand; PAM type: YTN; PAM sequence: CTG
tgcagtgccactgcactcca

SEQ ID NO: 13615 - DNA, 20 bp, Artificial Sequence
  Description of Artificial Sequence: Synthetic oligonucleotide
  Target: ANGPTL3; (-) strand; PAM type: YTN; PAM sequence: CTC
actgtgcagtgccactgcac

SEQ ID NO: 13616 - DNA, 20 bp, Artificial Sequence
  Description of Artificial Sequence: Synthetic oligonucleotide
  Target: ANGPTL3; (-) strand; PAM type: YTN; PAM sequence: CTC
agctcactgtgcagtgccac

SEQ ID NO: 13617 - DNA, 20 bp, Artificial Sequence
  Description of Artificial Sequence: Synthetic oligonucleotide
  Target: ANGPTL3; (-) strand; PAM type: YTN; PAM sequence: CTG
agatcactcagctcactgtg

SEQ ID NO: 13618 - DNA, 20 bp, Artificial Sequence
  Description of Artificial Sequence: Synthetic oligonucleotide
  Target: ANGPTL3; (-) strand; PAM type: YTN; PAM sequence: TTG
cagagagctgagatcactca

SEQ ID NO: 13619 - DNA, 20 bp, Artificial Sequence
  Description of Artificial Sequence: Synthetic oligonucleotide
  Target: ANGPTL3; (-) strand; PAM type: YTN; PAM sequence: TTG
aacccaggaggcggaggttg

SEQ ID NO: 13620 - DNA, 20 bp, Artificial Sequence
  Description of Artificial Sequence: Synthetic oligonucleotide
  Target: ANGPTL3; (-) strand; PAM type: YTN; PAM sequence: CTT
gaacccaggaggcggaggtt

SEQ ID NO: 13621 - DNA, 20 bp, Artificial Sequence
  Description of Artificial Sequence: Synthetic oligonucleotide
  Target: ANGPTL3; (-) strand; PAM type: YTN; PAM sequence: CTG
aggcaggagaatcacttgaa

SEQ ID NO: 13622 - DNA, 20 bp, Artificial Sequence
  Description of Artificial Sequence: Synthetic oligonucleotide
  Target: ANGPTL3; (-) strand; PAM type: YTN; PAM sequence: CTC
aggagtctgaggcaggagaa

SEQ ID NO: 13623 - DNA, 20 bp, Artificial Sequence
  Description of Artificial Sequence: Synthetic oligonucleotide
  Target: ANGPTL3; (-) strand; PAM type: YTN; PAM sequence: CTA
ctcaggagtctgaggcagga

SEQ ID NO: 13624 - DNA, 20 bp, Artificial Sequence
  Description of Artificial Sequence: Synthetic oligonucleotide
  Target: ANGPTL3; (-) strand; PAM type: YTN; PAM sequence: CTA
gctactcaggagtctgaggc

SEQ ID NO: 13625 - DNA, 20 bp, Artificial Sequence
  Description of Artificial Sequence: Synthetic oligonucleotide
  Target: ANGPTL3; (-) strand; PAM type: YTN; PAM sequence: CTG
taatcctagctactcaggag

SEQ ID NO: 13626 - DNA, 20 bp, Artificial Sequence
  Description of Artificial Sequence: Synthetic oligonucleotide
  Target: ANGPTL3; (-) strand; PAM type: YTN; PAM sequence: TTA
gccaggcatggtggcacata

SEQ ID NO: 13627 - DNA, 20 bp, Artificial Sequence
  Description of Artificial Sequence: Synthetic oligonucleotide
  Target: ANGPTL3; (-) strand; PAM type: YTN; PAM sequence: CTA
aaaatacaaaaattagccag

SEQ ID NO: 13628 - DNA, 20 bp, Artificial Sequence
  Description of Artificial Sequence: Synthetic oligonucleotide
  Target: ANGPTL3; (-) strand; PAM type: YTN; PAM sequence: CTA
ctaaaaatacaaaaattagc

SEQ ID NO: 13629 - DNA, 20 bp, Artificial Sequence
  Description of Artificial Sequence: Synthetic oligonucleotide
  Target: ANGPTL3; (-) strand; PAM type: YTN; PAM sequence: CTC
tactaaaaatacaaaaatta

SEQ ID NO: 13630 - DNA, 20 bp, Artificial Sequence
  Description of Artificial Sequence: Synthetic oligonucleotide
  Target: ANGPTL3; (-) strand; PAM type: YTN; PAM sequence: CTC
cgtctctactaaaaatacaa

SEQ ID NO: 13631 - DNA, 20 bp, Artificial Sequence
  Description of Artificial Sequence: Synthetic oligonucleotide
  Target: ANGPTL3; (-) strand; PAM type: YTN; PAM sequence: CTG
accaacatgatgaaactccg

SEQ ID NO: 13632 - DNA, 20 bp, Artificial Sequence
  Description of Artificial Sequence: Synthetic oligonucleotide
  Target: ANGPTL3; (-) strand; PAM type: YTN; PAM sequence: TTC
gggaccagcctgaccaacat

SEQ ID NO: 13633 - DNA, 20 bp, Artificial Sequence
  Description of Artificial Sequence: Synthetic oligonucleotide
  Target: ANGPTL3; (-) strand; PAM type: YTN; PAM sequence: TTG
ggaggccgaggaaggcggat

SEQ ID NO: 13634 - DNA, 20 bp, Artificial Sequence
  Description of Artificial Sequence: Synthetic oligonucleotide
  Target: ANGPTL3; (-) strand; PAM type: YTN; PAM sequence: TTT
gggaggccgaggaaggcgga

SEQ ID NO: 13635 - DNA, 20 bp, Artificial Sequence
  Description of Artificial Sequence: Synthetic oligonucleotide
  Target: ANGPTL3; (-) strand; PAM type: YTN; PAM sequence: CTT
tgggaggccgaggaaggcgg

SEQ ID NO: 13636 - DNA, 20 bp, Artificial Sequence
  Description of Artificial Sequence: Synthetic oligonucleotide
  Target: ANGPTL3; (-) strand; PAM type: YTN; PAM sequence: TTA
gcactttgggaggccgagga

SEQ ID NO: 13637 - DNA, 20 bp, Artificial Sequence
  Description of Artificial Sequence: Synthetic oligonucleotide
  Target: ANGPTL3; (-) strand; PAM type: YTN; PAM sequence: CTT
agcactttgggaggccgagg

SEQ ID NO: 13638 - DNA, 20 bp, Artificial Sequence
  Description of Artificial Sequence: Synthetic oligonucleotide
  Target: ANGPTL3; (-) strand; PAM type: YTN; PAM sequence: CTG
taatcttagcactttgggag

SEQ ID NO: 13639 - DNA, 20 bp, Artificial Sequence
  Description of Artificial Sequence: Synthetic oligonucleotide
  Target: ANGPTL3; (-) strand; PAM type: YTN; PAM sequence: CTC
acgcctgtaatcttagcact

SEQ ID NO: 13640 - DNA, 20 bp, Artificial Sequence
  Description of Artificial Sequence: Synthetic oligonucleotide
  Target: ANGPTL3; (-) strand; PAM type: YTN; PAM sequence: CTG
ggcgcgggggctcacgcctg

SEQ ID NO: 13641 - DNA, 20 bp, Artificial Sequence
  Description of Artificial Sequence: Synthetic oligonucleotide
  Target: ANGPTL3; (-) strand; PAM type: YTN; PAM sequence: CTG
agtcggctgggcgcgggggc

SEQ ID NO: 13642 - DNA, 20 bp, Artificial Sequence
  Description of Artificial Sequence: Synthetic oligonucleotide
  Target: ANGPTL3; (-) strand; PAM type: YTN; PAM sequence: CTA
taaaaactgagtcggctggg

SEQ ID NO: 13643 - DNA, 20 bp, Artificial Sequence
  Description of Artificial Sequence: Synthetic oligonucleotide
  Target: ANGPTL3; (-) strand; PAM type: YTN; PAM sequence: TTA
actataaaaactgagtcggc

SEQ ID NO: 13644 - DNA, 20 bp, Artificial Sequence
  Description of Artificial Sequence: Synthetic oligonucleotide
  Target: ANGPTL3; (-) strand; PAM type: YTN; PAM sequence: TTT
aactataaaaactgagtcgg

SEQ ID NO: 13645 - DNA, 20 bp, Artificial Sequence
  Description of Artificial Sequence: Synthetic oligonucleotide
  Target: ANGPTL3; (-) strand; PAM type: YTN; PAM sequence: TTT
taactataaaaactgagtcg

SEQ ID NO: 13646 - DNA, 20 bp, Artificial Sequence
  Description of Artificial Sequence: Synthetic oligonucleotide
  Target: ANGPTL3; (-) strand; PAM type: YTN; PAM sequence: TTA
ttttaactataaaaactgag

SEQ ID NO: 13647 - DNA, 20 bp, Artificial Sequence
  Description of Artificial Sequence: Synthetic oligonucleotide
  Target: ANGPTL3; (-) strand; PAM type: YTN; PAM sequence: TTT
attttaactataaaaactga

SEQ ID NO: 13648 - DNA, 20 bp, Artificial Sequence
  Description of Artificial Sequence: Synthetic oligonucleotide
  Target: ANGPTL3; (-) strand; PAM type: YTN; PAM sequence: CTA
gtttattttaactataaaaa

SEQ ID NO: 13649 - DNA, 20 bp, Artificial Sequence
  Description of Artificial Sequence: Synthetic oligonucleotide
  Target: ANGPTL3; (-) strand; PAM type: YTN; PAM sequence: TTG
gtcctagtttattttaacta

SEQ ID NO: 13650 - DNA, 20 bp, Artificial Sequence
  Description of Artificial Sequence: Synthetic oligonucleotide
  Target: ANGPTL3; (-) strand; PAM type: YTN; PAM sequence: CTA
tcgaattggtcctagtttat

SEQ ID NO: 13651 - DNA, 20 bp, Artificial Sequence
  Description of Artificial Sequence: Synthetic oligonucleotide
  Target: ANGPTL3; (-) strand; PAM type: YTN; PAM sequence: TTC
tatcgaattggtcctagttt

SEQ ID NO: 13652 - DNA, 20 bp, Artificial Sequence
  Description of Artificial Sequence: Synthetic oligonucleotide
  Target: ANGPTL3; (-) strand; PAM type: YTN; PAM sequence: TTA
ttctatcgaattggtcctag

SEQ ID NO: 13653 - DNA, 20 bp, Artificial Sequence
  Description of Artificial Sequence: Synthetic oligonucleotide
  Target: ANGPTL3; (-) strand; PAM type: YTN; PAM sequence: TTT
attctatcgaattggtccta

SEQ ID NO: 13654 - DNA, 20 bp, Artificial Sequence
  Description of Artificial Sequence: Synthetic oligonucleotide
  Target: ANGPTL3; (-) strand; PAM type: YTN; PAM sequence: TTT
tattctatcgaattggtcct

SEQ ID NO: 13655 - DNA, 20 bp, Artificial Sequence
  Description of Artificial Sequence: Synthetic oligonucleotide
  Target: ANGPTL3; (-) strand; PAM type: YTN; PAM sequence: CTG
agttttattctatcgaattg

SEQ ID NO: 13656 - DNA, 20 bp, Artificial Sequence
  Description of Artificial Sequence: Synthetic oligonucleotide
  Target: ANGPTL3; (-) strand; PAM type: YTN; PAM sequence: CTC
tgagttttattctatcgaat

SEQ ID NO: 13657 - DNA, 20 bp, Artificial Sequence
  Description of Artificial Sequence: Synthetic oligonucleotide
  Target: ANGPTL3; (-) strand; PAM type: YTN; PAM sequence: TTA
taccactctgagttttattc

SEQ ID NO: 13658 - DNA, 20 bp, Artificial Sequence
  Description of Artificial Sequence: Synthetic oligonucleotide
  Target: ANGPTL3; (-) strand; PAM type: YTN; PAM sequence: TTG
ttataccactctgagtttta

SEQ ID NO: 13659 - DNA, 20 bp, Artificial Sequence
  Description of Artificial Sequence: Synthetic oligonucleotide
  Target: ANGPTL3; (-) strand; PAM type: YTN; PAM sequence: CTT
gttataccactctgagtttt

SEQ ID NO: 13660 - DNA, 20 bp, Artificial Sequence
  Description of Artificial Sequence: Synthetic oligonucleotide
  Target: ANGPTL3; (-) strand; PAM type: YTN; PAM sequence: TTG
tccttgttataccactctga

SEQ ID NO: 13661 - DNA, 20 bp, Artificial Sequence
  Description of Artificial Sequence: Synthetic oligonucleotide
  Target: ANGPTL3; (-) strand; PAM type: YTN; PAM sequence: TTT
gtccttgttataccactctg

SEQ ID NO: 13662 - DNA, 20 bp, Artificial Sequence
  Description of Artificial Sequence: Synthetic oligonucleotide
  Target: ANGPTL3; (-) strand; PAM type: YTN; PAM sequence: TTT
tgtccttgttataccactct

SEQ ID NO: 13663 - DNA, 20 bp, Artificial Sequence
  Description of Artificial Sequence: Synthetic oligonucleotide
  Target: ANGPTL3; (-) strand; PAM type: YTN; PAM sequence: TTG
gttttgtccttgttatacca

SEQ ID NO: 13664 - DNA, 20 bp, Artificial Sequence
  Description of Artificial Sequence: Synthetic oligonucleotide
  Target: ANGPTL3; (-) strand; PAM type: YTN; PAM sequence: TTT
ggttttgtccttgttatacc

SEQ ID NO: 13665 - DNA, 20 bp, Artificial Sequence
  Description of Artificial Sequence: Synthetic oligonucleotide
  Target: ANGPTL3; (-) strand; PAM type: YTN; PAM sequence: TTT
tggttttgtccttgttatac

SEQ ID NO: 13666 - DNA, 20 bp, Artificial Sequence
  Description of Artificial Sequence: Synthetic oligonucleotide
  Target: ANGPTL3; (-) strand; PAM type: YTN; PAM sequence: CTA
ttttggttttgtccttgtta

SEQ ID NO: 13667 - DNA, 20 bp, Artificial Sequence
  Description of Artificial Sequence: Synthetic oligonucleotide
  Target: ANGPTL3; (-) strand; PAM type: YTN; PAM sequence: CTG
ctattttggttttgtccttg

SEQ ID NO: 13668 - DNA, 20 bp, Artificial Sequence
  Description of Artificial Sequence: Synthetic oligonucleotide
  Target: ANGPTL3; (-) strand; PAM type: YTN; PAM sequence: CTC
tgctattttggttttgtcct

SEQ ID NO: 13669 - DNA, 20 bp, Artificial Sequence
  Description of Artificial Sequence: Synthetic oligonucleotide
  Target: ANGPTL3; (-) strand; PAM type: YTN; PAM sequence: CTG
ccacatactctgctattttg

SEQ ID NO: 13670 - DNA, 20 bp, Artificial Sequence
  Description of Artificial Sequence: Synthetic oligonucleotide
  Target: ANGPTL3; (-) strand; PAM type: YTN; PAM sequence: CTA
ctgccacatactctgctatt

SEQ ID NO: 13671 - DNA, 20 bp, Artificial Sequence
  Description of Artificial Sequence: Synthetic oligonucleotide
  Target: ANGPTL3; (-) strand; PAM type: YTN; PAM sequence: CTC
aagctactgccacatactct

SEQ ID NO: 13672 - DNA, 20 bp, Artificial Sequence
  Description of Artificial Sequence: Synthetic oligonucleotide
  Target: ANGPTL3; (-) strand; PAM type: YTN; PAM sequence: TTC
atagatgtctcaagctactg

SEQ ID NO: 13673 - DNA, 20 bp, Artificial Sequence
  Description of Artificial Sequence: Synthetic oligonucleotide
  Target: ANGPTL3; (-) strand; PAM type: YTN; PAM sequence: TTA
gagttcatagatgtctcaag

SEQ ID NO: 13674 - DNA, 20 bp, Artificial Sequence
  Description of Artificial Sequence: Synthetic oligonucleotide
  Target: ANGPTL3; (-) strand; PAM type: YTN; PAM sequence: TTT
agagttcatagatgtctcaa

SEQ ID NO: 13675 - DNA, 20 bp, Artificial Sequence
  Description of Artificial Sequence: Synthetic oligonucleotide
  Target: ANGPTL3; (-) strand; PAM type: YTN; PAM sequence: TTT
tagagttcatagatgtctca

SEQ ID NO: 13676 - DNA, 20 bp, Artificial Sequence
  Description of Artificial Sequence: Synthetic oligonucleotide
  Target: ANGPTL3; (-) strand; PAM type: YTN; PAM sequence: TTT
ttagagttcatagatgtctc

SEQ ID NO: 13677 - DNA, 20 bp, Artificial Sequence
  Description of Artificial Sequence: Synthetic oligonucleotide
  Target: ANGPTL3; (-) strand; PAM type: YTN; PAM sequence: TTA
tttttagagttcatagatgt

SEQ ID NO: 13678 - DNA, 20 bp, Artificial Sequence
  Description of Artificial Sequence: Synthetic oligonucleotide
  Target: ANGPTL3; (-) strand; PAM type: YTN; PAM sequence: TTT
atttttagagttcatagatg

SEQ ID NO: 13679 - DNA, 20 bp, Artificial Sequence
  Description of Artificial Sequence: Synthetic oligonucleotide
  Target: ANGPTL3; (-) strand; PAM type: YTN; PAM sequence: TTT
tatttttagagttcatagat

SEQ ID NO: 13680 - DNA, 20 bp, Artificial Sequence
  Description of Artificial Sequence: Synthetic oligonucleotide
  Target: ANGPTL3; (-) strand; PAM type: YTN; PAM sequence: TTT
ttatttttagagttcataga

SEQ ID NO: 13681 - DNA, 20 bp, Artificial Sequence
  Description of Artificial Sequence: Synthetic oligonucleotide
  Target: ANGPTL3; (-) strand; PAM type: YTN; PAM sequence: TTG
tttttatttttagagttcat

SEQ ID NO: 13682 - DNA, 20 bp, Artificial Sequence
  Description of Artificial Sequence: Synthetic oligonucleotide
  Target: ANGPTL3; (-) strand; PAM type: YTN; PAM sequence: TTT
gtttttatttttagagttca

SEQ ID NO: 13683 - DNA, 20 bp, Artificial Sequence
  Description of Artificial Sequence: Synthetic oligonucleotide
  Target: ANGPTL3; (-) strand; PAM type: YTN; PAM sequence: TTT
tgtttttatttttagagttc

SEQ ID NO: 13684 - DNA, 20 bp, Artificial Sequence
  Description of Artificial Sequence: Synthetic oligonucleotide
  Target: ANGPTL3; (-) strand; PAM type: YTN; PAM sequence: TTT
ttgtttttatttttagagtt

SEQ ID NO: 13685 - DNA, 20 bp, Artificial Sequence
  Description of Artificial Sequence: Synthetic oligonucleotide
  Target: ANGPTL3; (-) strand; PAM type: YTN; PAM sequence: TTG
gtttttgtttttatttttag

SEQ ID NO: 13686 - DNA, 20 bp, Artificial Sequence
  Description of Artificial Sequence: Synthetic oligonucleotide
  Target: ANGPTL3; (-) strand; PAM type: YTN; PAM sequence: TTC
agaaagtattggtttttgtt

SEQ ID NO: 13687 - DNA, 20 bp, Artificial Sequence
  Description of Artificial Sequence: Synthetic oligonucleotide
  Target: ANGPTL3; (-) strand; PAM type: YTN; PAM sequence: CTT
cagaaagtattggtttttgt

SEQ ID NO: 13688 - DNA, 20 bp, Artificial Sequence
  Description of Artificial Sequence: Synthetic oligonucleotide
  Target: ANGPTL3; (-) strand; PAM type: YTN; PAM sequence: CTG
cttcagaaagtattggtttt

SEQ ID NO: 13689 - DNA, 20 bp, Artificial Sequence
  Description of Artificial Sequence: Synthetic oligonucleotide
  Target: ANGPTL3; (-) strand; PAM type: YTN; PAM sequence: CTC
tgcttcagaaagtattggtt

SEQ ID NO: 13690 - DNA, 20 bp, Artificial Sequence
  Description of Artificial Sequence: Synthetic oligonucleotide
  Target: ANGPTL3; (-) strand; PAM type: YTN; PAM sequence: TTC
tctgcttcagaaagtattgg

SEQ ID NO: 13691 - DNA, 20 bp, Artificial Sequence
  Description of Artificial Sequence: Synthetic oligonucleotide
  Target: ANGPTL3; (-) strand; PAM type: YTN; PAM sequence: TTC
aagtgtatggttctctgctt

SEQ ID NO: 13692 - DNA, 20 bp, Artificial Sequence
  Description of Artificial Sequence: Synthetic oligonucleotide
  Target: ANGPTL3; (-) strand; PAM type: YTN; PAM sequence: CTA
ttcaagtgtatggttctctg

SEQ ID NO: 13693 - DNA, 20 bp, Artificial Sequence
  Description of Artificial Sequence: Synthetic oligonucleotide
  Target: ANGPTL3; (-) strand; PAM type: YTN; PAM sequence: TTC
tattcaagtgtatggttctc

SEQ ID NO: 13694 - DNA, 20 bp, Artificial Sequence
  Description of Artificial Sequence: Synthetic oligonucleotide
  Target: ANGPTL3; (-) strand; PAM type: YTN; PAM sequence: TTT
ctattcaagtgtatggttct

SEQ ID NO: 13695 - DNA, 20 bp, Artificial Sequence
  Description of Artificial Sequence: Synthetic oligonucleotide
  Target: ANGPTL3; (-) strand; PAM type: YTN; PAM sequence: TTT
tctattcaagtgtatggttc

SEQ ID NO: 13696 - DNA, 20 bp, Artificial Sequence
  Description of Artificial Sequence: Synthetic oligonucleotide
  Target: ANGPTL3; (-) strand; PAM type: YTN; PAM sequence: TTT
ttctattcaagtgtatggtt

SEQ ID NO: 13697 - DNA, 20 bp, Artificial Sequence
  Description of Artificial Sequence: Synthetic oligonucleotide
  Target: ANGPTL3; (-) strand; PAM type: YTN; PAM sequence: TTT
tttctattcaagtgtatggt

SEQ ID NO: 13698 - DNA, 20 bp, Artificial Sequence
  Description of Artificial Sequence: Synthetic oligonucleotide
  Target: ANGPTL3; (-) strand; PAM type: YTN; PAM sequence: TTT
ttttctattcaagtgtatgg

SEQ ID NO: 13699 - DNA, 20 bp, Artificial Sequence
  Description of Artificial Sequence: Synthetic oligonucleotide
  Target: ANGPTL3; (-) strand; PAM type: YTN; PAM sequence: TTT
tttttctattcaagtgtatg

SEQ ID NO: 13700 - DNA, 20 bp, Artificial Sequence
  Description of Artificial Sequence: Synthetic oligonucleotide
  Target: ANGPTL3; (-) strand; PAM type: YTN; PAM sequence: TTT
ttttttctattcaagtgtat

SEQ ID NO: 13701 - DNA, 20 bp, Artificial Sequence
  Description of Artificial Sequence: Synthetic oligonucleotide
  Target: ANGPTL3; (-) strand; PAM type: YTN; PAM sequence: TTC
aggagcatttttttttctat

SEQ ID NO: 13702 - DNA, 20 bp, Artificial Sequence
  Description of Artificial Sequence: Synthetic oligonucleotide
  Target: ANGPTL3; (-) strand; PAM type: YTN; PAM sequence: CTG
aaaattcaggagcatttttt

SEQ ID NO: 13703 - DNA, 20 bp, Artificial Sequence
  Description of Artificial Sequence: Synthetic oligonucleotide
  Target: ANGPTL3; (-) strand; PAM type: YTN; PAM sequence: TTA
ctgaaaattcaggagcattt

SEQ ID NO: 13704 - DNA, 20 bp, Artificial Sequence
  Description of Artificial Sequence: Synthetic oligonucleotide
  Target: ANGPTL3; (-) strand; PAM type: YTN; PAM sequence: CTG
aacgttactgaaaattcagg

SEQ ID NO: 13705 - DNA, 20 bp, Artificial Sequence
  Description of Artificial Sequence: Synthetic oligonucleotide
  Target: ANGPTL3; (-) strand; PAM type: YTN; PAM sequence: TTC
agctgaacgttactgaaaat

SEQ ID NO: 13706 - DNA, 20 bp, Artificial Sequence
  Description of Artificial Sequence: Synthetic oligonucleotide
  Target: ANGPTL3; (-) strand; PAM type: YTN; PAM sequence: TTT
cagctgaacgttactgaaaa

SEQ ID NO: 13707 - DNA, 20 bp, Artificial Sequence
  Description of Artificial Sequence: Synthetic oligonucleotide
  Target: ANGPTL3; (-) strand; PAM type: YTN; PAM sequence: TTA
aggaagtataaatttcagct

SEQ ID NO: 13708 - DNA, 20 bp, Artificial Sequence
  Description of Artificial Sequence: Synthetic oligonucleotide
  Target: ANGPTL3; (-) strand; PAM type: YTN; PAM sequence: TTT
aaggaagtataaatttcagc

SEQ ID NO: 13709 - DNA, 20 bp, Artificial Sequence
  Description of Artificial Sequence: Synthetic oligonucleotide
  Target: ANGPTL3; (-) strand; PAM type: YTN; PAM sequence: TTC
ataatttaaggaagtataaa

SEQ ID NO: 13710 - DNA, 20 bp, Artificial Sequence
  Description of Artificial Sequence: Synthetic oligonucleotide
  Target: ANGPTL3; (-) strand; PAM type: YTN; PAM sequence: CTA
cattcataatttaaggaagt

SEQ ID NO: 13711 - DNA, 20 bp, Artificial Sequence
  Description of Artificial Sequence: Synthetic oligonucleotide
  Target: ANGPTL3; (-) strand; PAM type: YTN; PAM sequence: TTA
ctacattcataatttaagga

SEQ ID NO: 13712 - DNA, 20 bp, Artificial Sequence
  Description of Artificial Sequence: Synthetic oligonucleotide
  Target: ANGPTL3; (-) strand; PAM type: YTN; PAM sequence: TTT
actacattcataatttaagg

SEQ ID NO: 13713 - DNA, 20 bp, Artificial Sequence
  Description of Artificial Sequence: Synthetic oligonucleotide
  Target: ANGPTL3; (-) strand; PAM type: YTN; PAM sequence: TTG
gtttactacattcataattt

SEQ ID NO: 13714 - DNA, 20 bp, Artificial Sequence
  Description of Artificial Sequence: Synthetic oligonucleotide
  Target: ANGPTL3; (-) strand; PAM type: YTN; PAM sequence: CTG
tggttggtttactacattca

SEQ ID NO: 13715 - DNA, 20 bp, Artificial Sequence
  Description of Artificial Sequence: Synthetic oligonucleotide
  Target: ANGPTL3; (-) strand; PAM type: YTN; PAM sequence: CTG
ctgtggttggtttactacat

SEQ ID NO: 13716 - DNA, 20 bp, Artificial Sequence
  Description of Artificial Sequence: Synthetic oligonucleotide
  Target: ANGPTL3; (-) strand; PAM type: YTN; PAM sequence: CTG
gtaatactgctgtggttggt

SEQ ID NO: 13717 - DNA, 20 bp, Artificial Sequence
  Description of Artificial Sequence: Synthetic oligonucleotide
  Target: ANGPTL3; (-) strand; PAM type: YTN; PAM sequence: TTA
tatactggtaatactgctgt

SEQ ID NO: 13718 - DNA, 20 bp, Artificial Sequence
  Description of Artificial Sequence: Synthetic oligonucleotide
  Target: ANGPTL3; (-) strand; PAM type: YTN; PAM sequence: CTT
atatactggtaatactgctg

SEQ ID NO: 13719 - DNA, 20 bp, Artificial Sequence
  Description of Artificial Sequence: Synthetic oligonucleotide
  Target: ANGPTL3; (-) strand; PAM type: YTN; PAM sequence: TTA
atgacaaaatcttatatact

SEQ ID NO: 13720 - DNA, 20 bp, Artificial Sequence
  Description of Artificial Sequence: Synthetic oligonucleotide
  Target: ANGPTL3; (-) strand; PAM type: YTN; PAM sequence: CTA
ttaatgacaaaatcttatat

SEQ ID NO: 13721 - DNA, 20 bp, Artificial Sequence
  Description of Artificial Sequence: Synthetic oligonucleotide
  Target: ANGPTL3; (-) strand; PAM type: YTN; PAM sequence: TTC
tattaatgacaaaatcttat

SEQ ID NO: 13722 - DNA, 20 bp, Artificial Sequence
  Description of Artificial Sequence: Synthetic oligonucleotide
  Target: ANGPTL3; (-) strand; PAM type: YTN; PAM sequence: TTT
ctattaatgacaaaatctta

SEQ ID NO: 13723 - DNA, 20 bp, Artificial Sequence
  Description of Artificial Sequence: Synthetic oligonucleotide
  Target: ANGPTL3; (-) strand; PAM type: YTN; PAM sequence: TTA
aagtataataataataataa

SEQ ID NO: 13724 - DNA, 20 bp, Artificial Sequence
  Description of Artificial Sequence: Synthetic oligonucleotide
  Target: ANGPTL3; (-) strand; PAM type: YTN; PAM sequence: CTT
aaagtataataataataata

SEQ ID NO: 13725 - DNA, 20 bp, Artificial Sequence
  Description of Artificial Sequence: Synthetic oligonucleotide
  Target: ANGPTL3; (-) strand; PAM type: YTN; PAM sequence: CTG
cgcatgtatcccagaactta

SEQ ID NO: 13726 - DNA, 20 bp, Artificial Sequence
  Description of Artificial Sequence: Synthetic oligonucleotide
  Target: ANGPTL3; (-) strand; PAM type: YTN; PAM sequence: TTC
tgcgcatgtatcccagaact

SEQ ID NO: 13727 - DNA, 20 bp, Artificial Sequence
  Description of Artificial Sequence: Synthetic oligonucleotide
  Target: ANGPTL3; (-) strand; PAM type: YTN; PAM sequence: CTG
cacgttctgcgcatgtatcc

SEQ ID NO: 13728 - DNA, 20 bp, Artificial Sequence
  Description of Artificial Sequence: Synthetic oligonucleotide
  Target: ANGPTL3; (-) strand; PAM type: YTN; PAM sequence: CTA
tgtaacaaaactgcacgttc

SEQ ID NO: 13729 - DNA, 20 bp, Artificial Sequence
  Description of Artificial Sequence: Synthetic oligonucleotide
  Target: ANGPTL3; (-) strand; PAM type: YTN; PAM sequence: TTG
atgggtgcagcaaaccacca

SEQ ID NO: 13730 - DNA, 20 bp, Artificial Sequence
  Description of Artificial Sequence: Synthetic oligonucleotide
  Target: ANGPTL3; (-) strand; PAM type: YTN; PAM sequence: CTA
atgtagatgacgggttgatg

SEQ ID NO: 13731 - DNA, 20 bp, Artificial Sequence
  Description of Artificial Sequence: Synthetic oligonucleotide
  Target: ANGPTL3; (-) strand; PAM type: YTN; PAM sequence: TTA
ggagaaatacctaatgtaga

SEQ ID NO: 13732 - DNA, 20 bp, Artificial Sequence
  Description of Artificial Sequence: Synthetic oligonucleotide
  Target: ANGPTL3; (-) strand; PAM type: YTN; PAM sequence: CTA
ggggagggatagcattagga

SEQ ID NO: 13733 - DNA, 20 bp, Artificial Sequence
  Description of Artificial Sequence: Synthetic oligonucleotide
  Target: ANGPTL3; (-) strand; PAM type: YTN; PAM sequence: CTG
tcggggtggggctaggggag

SEQ ID NO: 13734 - DNA, 20 bp, Artificial Sequence
  Description of Artificial Sequence: Synthetic oligonucleotide
  Target: ANGPTL3; (-) strand; PAM type: YTN; PAM sequence: CTG
ggacctgtcggggtggggct

SEQ ID NO: 13735 - DNA, 20 bp, Artificial Sequence
  Description of Artificial Sequence: Synthetic oligonucleotide
  Target: ANGPTL3; (-) strand; PAM type: YTN; PAM sequence: CTA
aacaatgagaacacatggac

SEQ ID NO: 13736 - DNA, 20 bp, Artificial Sequence
  Description of Artificial Sequence: Synthetic oligonucleotide
  Target: ANGPTL3; (-) strand; PAM type: YTN; PAM sequence: CTC
ataagtgggagctaaacaat

SEQ ID NO: 13737 - DNA, 20 bp, Artificial Sequence
  Description of Artificial Sequence: Synthetic oligonucleotide
  Target: ANGPTL3; (-) strand; PAM type: YTN; PAM sequence: CTC
actcataagtgggagctaaa

SEQ ID NO: 13738 - DNA, 20 bp, Artificial Sequence
  Description of Artificial Sequence: Synthetic oligonucleotide
  Target: ANGPTL3; (-) strand; PAM type: YTN; PAM sequence: TTC
tcactcataagtgggagcta

SEQ ID NO: 13739 - DNA, 20 bp, Artificial Sequence
  Description of Artificial Sequence: Synthetic oligonucleotide
  Target: ANGPTL3; (-) strand; PAM type: YTN; PAM sequence: CTA
acacaggaacagaaaaccaa

SEQ ID NO: 13740 - DNA, 20 bp, Artificial Sequence
  Description of Artificial Sequence: Synthetic oligonucleotide
  Target: ANGPTL3; (-) strand; PAM type: YTN; PAM sequence: CTC
agcaaactaacacaggaaca

SEQ ID NO: 13741 - DNA, 20 bp, Artificial Sequence
  Description of Artificial Sequence: Synthetic oligonucleotide
  Target: ANGPTL3; (-) strand; PAM type: YTN; PAM sequence: TTC
tcagcaaactaacacaggaa

SEQ ID NO: 13742 - DNA, 20 bp, Artificial Sequence
  Description of Artificial Sequence: Synthetic oligonucleotide
  Target: ANGPTL3; (-) strand; PAM type: YTN; PAM sequence: CTG
gaaaccatcattctcagcaa

SEQ ID NO: 13743 - DNA, 20 bp, Artificial Sequence
  Description of Artificial Sequence: Synthetic oligonucleotide
  Target: ANGPTL3; (-) strand; PAM type: YTN; PAM sequence: TTG
tagggacatggatgaagctg

SEQ ID NO: 13744 - DNA, 20 bp, Artificial Sequence
  Description of Artificial Sequence: Synthetic oligonucleotide
  Target: ANGPTL3; (-) strand; PAM type: YTN; PAM sequence: TTT
gtagggacatggatgaagct

SEQ ID NO: 13745 - DNA, 20 bp, Artificial Sequence
  Description of Artificial Sequence: Synthetic oligonucleotide
  Target: ANGPTL3; (-) strand; PAM type: YTN; PAM sequence: CTT
tgtagggacatggatgaagc

SEQ ID NO: 13746 - DNA, 20 bp, Artificial Sequence
  Description of Artificial Sequence: Synthetic oligonucleotide
  Target: ANGPTL3; (-) strand; PAM type: YTN; PAM sequence: TTC
atgtcctttgtagggacatg

SEQ ID NO: 13747 - DNA, 20 bp, Artificial Sequence
  Description of Artificial Sequence: Synthetic oligonucleotide
  Target: ANGPTL3; (-) strand; PAM type: YTN; PAM sequence: CTA
tgcagccataaaaaaggatg

SEQ ID NO: 13748 - DNA, 20 bp, Artificial Sequence
  Description of Artificial Sequence: Synthetic oligonucleotide
  Target: ANGPTL3; (-) strand; PAM type: YTN; PAM sequence: CTG
gatgaagaaaatgtggcaca

SEQ ID NO: 13749 - DNA, 20 bp, Artificial Sequence
  Description of Artificial Sequence: Synthetic oligonucleotide
  Target: ANGPTL3; (-) strand; PAM type: YTN; PAM sequence: TTG
gaaccaacccaaatgcccat

SEQ ID NO: 13750 - DNA, 20 bp, Artificial Sequence
  Description of Artificial Sequence: Synthetic oligonucleotide
  Target: ANGPTL3; (-) strand; PAM type: YTN; PAM sequence: CTT
ggaaccaacccaaatgccca

SEQ ID NO: 13751 - DNA, 20 bp, Artificial Sequence
  Description of Artificial Sequence: Synthetic oligonucleotide
  Target: ANGPTL3; (-) strand; PAM type: YTN; PAM sequence: TTC
acaataacaaagacttggaa

SEQ ID NO: 13752 - DNA, 20 bp, Artificial Sequence
  Description of Artificial Sequence: Synthetic oligonucleotide
  Target: ANGPTL3; (-) strand; PAM type: YTN; PAM sequence: CTA
ttcacaataacaaagacttg

SEQ ID NO: 13753 - DNA, 20 bp, Artificial Sequence
  Description of Artificial Sequence: Synthetic oligonucleotide
  Target: ANGPTL3; (-) strand; PAM type: YTN; PAM sequence: TTG
cagcactattcacaataaca

SEQ ID NO: 13754 - DNA, 20 bp, Artificial Sequence
  Description of Artificial Sequence: Synthetic oligonucleotide
  Target: ANGPTL3; (-) strand; PAM type: YTN; PAM sequence: TTA
ttgcagcactattcacaata

SEQ ID NO: 13755 - DNA, 20 bp, Artificial Sequence
  Description of Artificial Sequence: Synthetic oligonucleotide
  Target: ANGPTL3; (-) strand; PAM type: YTN; PAM sequence: TTT
attgcagcactattcacaat

SEQ ID NO: 13756 - DNA, 20 bp, Artificial Sequence
  Description of Artificial Sequence: Synthetic oligonucleotide
  Target: ANGPTL3; (-) strand; PAM type: YTN; PAM sequence: CTA
taaagacacatgcacacatg

SEQ ID NO: 13757 - DNA, 20 bp, Artificial Sequence
  Description of Artificial Sequence: Synthetic oligonucleotide
  Target: ANGPTL3; (-) strand; PAM type: YTN; PAM sequence: CTA
ctataaagacacatgcacac

SEQ ID NO: 13758 - DNA, 20 bp, Artificial Sequence
  Description of Artificial Sequence: Synthetic oligonucleotide
  Target: ANGPTL3; (-) strand; PAM type: YTN; PAM sequence: TTC
tactataaagacacatgcac

SEQ ID NO: 13759 - DNA, 20 bp, Artificial Sequence
  Description of Artificial Sequence: Synthetic oligonucleotide
  Target: ANGPTL3; (-) strand; PAM type: YTN; PAM sequence: TTA
taaatcattctactataaag

SEQ ID NO: 13760 - DNA, 20 bp, Artificial Sequence
  Description of Artificial Sequence: Synthetic oligonucleotide
  Target: ANGPTL3; (-) strand; PAM type: YTN; PAM sequence: TTC
aaaggattataaatcattct

SEQ ID NO: 13761 - DNA, 20 bp, Artificial Sequence
  Description of Artificial Sequence: Synthetic oligonucleotide
  Target: ANGPTL3; (-) strand; PAM type: YTN; PAM sequence: TTG
ggtatatattcaaaggatta

SEQ ID NO: 13762 - DNA, 20 bp, Artificial Sequence
  Description of Artificial Sequence: Synthetic oligonucleotide
  Target: ANGPTL3; (-) strand; PAM type: YTN; PAM sequence: TTA
ttgggtatatattcaaagga

SEQ ID NO: 13763 - DNA, 20 bp, Artificial Sequence
  Description of Artificial Sequence: Synthetic oligonucleotide
  Target: ANGPTL3; (-) strand; PAM type: YTN; PAM sequence: TTG
acccagtaatcccattattg

SEQ ID NO: 13764 - DNA, 20 bp, Artificial Sequence
  Description of Artificial Sequence: Synthetic oligonucleotide
  Target: ANGPTL3; (-) strand; PAM type: YTN; PAM sequence: TTT
gacccagtaatcccattatt

SEQ ID NO: 13765 - DNA, 20 bp, Artificial Sequence
  Description of Artificial Sequence: Synthetic oligonucleotide
  Target: ANGPTL3; (-) strand; PAM type: YTN; PAM sequence: CTA
gaaataccatttgacccagt

SEQ ID NO: 13766 - DNA, 20 bp, Artificial Sequence
  Description of Artificial Sequence: Synthetic oligonucleotide
  Target: ANGPTL3; (-) strand; PAM type: YTN; PAM sequence: CTA
gaactagaaataccatttga

SEQ ID NO: 13767 - DNA, 20 bp, Artificial Sequence
  Description of Artificial Sequence: Synthetic oligonucleotide
  Target: ANGPTL3; (-) strand; PAM type: YTN; PAM sequence: CTC
aaggaactagaactagaaat

SEQ ID NO: 13768 - DNA, 20 bp, Artificial Sequence
  Description of Artificial Sequence: Synthetic oligonucleotide
  Target: ANGPTL3; (-) strand; PAM type: YTN; PAM sequence: TTC
ctcaaggaactagaactaga

SEQ ID NO: 13769 - DNA, 20 bp, Artificial Sequence
  Description of Artificial Sequence: Synthetic oligonucleotide
  Target: ANGPTL3; (-) strand; PAM type: YTN; PAM sequence: TTG
tggaagacagtgtggcgatt

SEQ ID NO: 13770 - DNA, 20 bp, Artificial Sequence
  Description of Artificial Sequence: Synthetic oligonucleotide
  Target: ANGPTL3; (-) strand; PAM type: YTN; PAM sequence: TTC
aaccattgtggaagacagtg

SEQ ID NO: 13771 - DNA, 20 bp, Artificial Sequence
  Description of Artificial Sequence: Synthetic oligonucleotide
  Target: ANGPTL3; (-) strand; PAM type: YTN; PAM sequence: TTA
gttcaaccattgtggaagac

SEQ ID NO: 13772 - DNA, 20 bp, Artificial Sequence
  Description of Artificial Sequence: Synthetic oligonucleotide
  Target: ANGPTL3; (-) strand; PAM type: YTN; PAM sequence: TTC
aaattagttcaaccattgtg

SEQ ID NO: 13773 - DNA, 20 bp, Artificial Sequence
  Description of Artificial Sequence: Synthetic oligonucleotide
  Target: ANGPTL3; (-) strand; PAM type: YTN; PAM sequence: TTT
caaattagttcaaccattgt

SEQ ID NO: 13774 - DNA, 20 bp, Artificial Sequence
  Description of Artificial Sequence: Synthetic oligonucleotide
  Target: ANGPTL3; (-) strand; PAM type: YTN; PAM sequence: TTG
tgatataaaaatatgtatgt

SEQ ID NO: 13775 - DNA, 20 bp, Artificial Sequence
  Description of Artificial Sequence: Synthetic oligonucleotide
  Target: ANGPTL3; (-) strand; PAM type: YTN; PAM sequence: CTA
taatagttgtgatataaaaa

SEQ ID NO: 13776 - DNA, 20 bp, Artificial Sequence
  Description of Artificial Sequence: Synthetic oligonucleotide
  Target: ANGPTL3; (-) strand; PAM type: YTN; PAM sequence: TTG
agatgtctataatagttgtg

SEQ ID NO: 13777 - DNA, 20 bp, Artificial Sequence
  Description of Artificial Sequence: Synthetic oligonucleotide
  Target: ANGPTL3; (-) strand; PAM type: YTN; PAM sequence: TTT
gagatgtctataatagttgt

SEQ ID NO: 13778 - DNA, 20 bp, Artificial Sequence
  Description of Artificial Sequence: Synthetic oligonucleotide
  Target: ANGPTL3; (-) strand; PAM type: YTN; PAM sequence: TTT
tgagatgtctataatagttg

SEQ ID NO: 13779 - DNA, 20 bp, Artificial Sequence
  Description of Artificial Sequence: Synthetic oligonucleotide
  Target: ANGPTL3; (-) strand; PAM type: YTN; PAM sequence: CTA
aatagtaataagcatcaaca

SEQ ID NO: 13780 - DNA, 20 bp, Artificial Sequence
  Description of Artificial Sequence: Synthetic oligonucleotide
  Target: ANGPTL3; (-) strand; PAM type: YTN; PAM sequence: TTC
taaatagtaataagcatcaa

SEQ ID NO: 13781 - DNA, 20 bp, Artificial Sequence
  Description of Artificial Sequence: Synthetic oligonucleotide
  Target: ANGPTL3; (-) strand; PAM type: YTN; PAM sequence: TTT
ctaaatagtaataagcatca

SEQ ID NO: 13782 - DNA, 20 bp, Artificial Sequence
  Description of Artificial Sequence: Synthetic oligonucleotide
  Target: ANGPTL3; (-) strand; PAM type: YTN; PAM sequence: TTT
tctaaatagtaataagcatc

SEQ ID NO: 13783 - DNA, 20 bp, Artificial Sequence
  Description of Artificial Sequence: Synthetic oligonucleotide
  Target: ANGPTL3; (-) strand; PAM type: YTN; PAM sequence: TTG
tattttctaaatagtaataa

SEQ ID NO: 13784 - DNA, 20 bp, Artificial Sequence
  Description of Artificial Sequence: Synthetic oligonucleotide
  Target: ANGPTL3; (-) strand; PAM type: YTN; PAM sequence: CTA
ttgtattttctaaatagtaa

SEQ ID NO: 13785 - DNA, 20 bp, Artificial Sequence
  Description of Artificial Sequence: Synthetic oligonucleotide
  Target: ANGPTL3; (-) strand; PAM type: YTN; PAM sequence: TTA
aaaaactattgtattttcta

SEQ ID NO: 13786 - DNA, 20 bp, Artificial Sequence
  Description of Artificial Sequence: Synthetic oligonucleotide
  Target: ANGPTL3; (+) strand; PAM type: YTN; PAM sequence: CTG
aaaaaatctattgtttgtta

SEQ ID NO: 13787 - DNA, 20 bp, Artificial Sequence
  Description of Artificial Sequence: Synthetic oligonucleotide
  Target: ANGPTL3; (+) strand; PAM type: YTN; PAM sequence: CTA
ttgtttgttatatatataac

SEQ ID NO: 13788 - DNA, 20 bp, Artificial Sequence
  Description of Artificial Sequence: Synthetic oligonucleotide
  Target: ANGPTL3; (+) strand; PAM type: YTN; PAM sequence: TTG
tttgttatatatataacaaa

SEQ ID NO: 13789 - DNA, 20 bp, Artificial Sequence
  Description of Artificial Sequence: Synthetic oligonucleotide
  Target: ANGPTL3; (+) strand; PAM type: YTN; PAM sequence: TTT
gttatatatataacaaagaa

SEQ ID NO: 13790 - DNA, 20 bp, Artificial Sequence
  Description of Artificial Sequence: Synthetic oligonucleotide
  Target: ANGPTL3; (+) strand; PAM type: YTN; PAM sequence: TTG
ttatatatataacaaagaat

SEQ ID NO: 13791 - DNA, 20 bp, Artificial Sequence
  Description of Artificial Sequence: Synthetic oligonucleotide
  Target: ANGPTL3; (+) strand; PAM type: YTN; PAM sequence: TTA
tatatataacaaagaattag

SEQ ID NO: 13792 - DNA, 20 bp, Artificial Sequence
  Description of Artificial Sequence: Synthetic oligonucleotide
  Target: ANGPTL3; (+) strand; PAM type: YTN; PAM sequence: TTA
gtatccacaatatgtaaata

SEQ ID NO: 13793 - DNA, 20 bp, Artificial Sequence
  Description of Artificial Sequence: Synthetic oligonucleotide
  Target: ANGPTL3; (+) strand; PAM type: YTN; PAM sequence: TTC
ctaaaattagtcagaaagag

SEQ ID NO: 13794 - DNA, 20 bp, Artificial Sequence
  Description of Artificial Sequence: Synthetic oligonucleotide
  Target: ANGPTL3; (+) strand; PAM type: YTN; PAM sequence: CTA
aaattagtcagaaagagaca

SEQ ID NO: 13795 - DNA, 20 bp, Artificial Sequence
  Description of Artificial Sequence: Synthetic oligonucleotide
  Target: ANGPTL3; (+) strand; PAM type: YTN; PAM sequence: TTA
gtcagaaagagacaaactta

SEQ ID NO: 13796 - DNA, 20 bp, Artificial Sequence
  Description of Artificial Sequence: Synthetic oligonucleotide
  Target: ANGPTL3; (+) strand; PAM type: YTN; PAM sequence: CTT
aaaaagagggtaacaaggag

SEQ ID NO: 13797 - DNA, 20 bp, Artificial Sequence
  Description of Artificial Sequence: Synthetic oligonucleotide
  Target: ANGPTL3; (+) strand; PAM type: YTN; PAM sequence: TTA
aaaagagggtaacaaggagg

SEQ ID NO: 13798 - DNA, 20 bp, Artificial Sequence
  Description of Artificial Sequence: Synthetic oligonucleotide
  Target: ANGPTL3; (+) strand; PAM type: YTN; PAM sequence: TTA
tgtacataaccagatgattc

SEQ ID NO: 13799 - DNA, 20 bp, Artificial Sequence
  Description of Artificial Sequence: Synthetic oligonucleotide
  Target: ANGPTL3; (+) strand; PAM type: YTN; PAM sequence: TTC
gcaaagacggcaacagagat

SEQ ID NO: 13800 - DNA, 20 bp, Artificial Sequence
  Description of Artificial Sequence: Synthetic oligonucleotide
  Target: ANGPTL3; (+) strand; PAM type: YTN; PAM sequence: CTA
gatatatacttgtctattag

SEQ ID NO: 13801 - DNA, 20 bp, Artificial Sequence
  Description of Artificial Sequence: Synthetic oligonucleotide
  Target: ANGPTL3; (+) strand; PAM type: YTN; PAM sequence: CTT
gtctattagatttatcaaca

SEQ ID NO: 13802 - DNA, 20 bp, Artificial Sequence
  Description of Artificial Sequence: Synthetic oligonucleotide
  Target: ANGPTL3; (+) strand; PAM type: YTN; PAM sequence: TTG
tctattagatttatcaacat

SEQ ID NO: 13803 - DNA, 20 bp, Artificial Sequence
  Description of Artificial Sequence: Synthetic oligonucleotide
  Target: ANGPTL3; (+) strand; PAM type: YTN; PAM sequence: CTA
ttagatttatcaacattttt

SEQ ID NO: 13804 - DNA, 20 bp, Artificial Sequence
  Description of Artificial Sequence: Synthetic oligonucleotide
  Target: ANGPTL3; (+) strand; PAM type: YTN; PAM sequence: TTA
gatttatcaacattttttgc

SEQ ID NO: 13805 - DNA, 20 bp, Artificial Sequence
  Description of Artificial Sequence: Synthetic oligonucleotide
  Target: ANGPTL3; (+) strand; PAM type: YTN; PAM sequence: TTT
atcaacattttttgcctttt

SEQ ID NO: 13806 - DNA, 20 bp, Artificial Sequence
  Description of Artificial Sequence: Synthetic oligonucleotide
  Target: ANGPTL3; (+) strand; PAM type: YTN; PAM sequence: TTA
tcaacattttttgccttttt

SEQ ID NO: 13807 - DNA, 20 bp, Artificial Sequence
  Description of Artificial Sequence: Synthetic oligonucleotide
  Target: ANGPTL3; (+) strand; PAM type: YTN; PAM sequence: TTT
tttgcctttttcattaaaag

SEQ ID NO: 13808 - DNA, 20 bp, Artificial Sequence
  Description of Artificial Sequence: Synthetic oligonucleotide
  Target: ANGPTL3; (+) strand; PAM type: YTN; PAM sequence: TTT
ttgcctttttcattaaaagc

SEQ ID NO: 13809 - DNA, 20 bp, Artificial Sequence
  Description of Artificial Sequence: Synthetic oligonucleotide
  Target: ANGPTL3; (+) strand; PAM type: YTN; PAM sequence: TTT
tgcctttttcattaaaagca

SEQ ID NO: 13810 - DNA, 20 bp, Artificial Sequence
  Description of Artificial Sequence: Synthetic oligonucleotide
  Target: ANGPTL3; (+) strand; PAM type: YTN; PAM sequence: TTT
gcctttttcattaaaagcat

SEQ ID NO: 13811 - DNA, 20 bp, Artificial Sequence
  Description of Artificial Sequence: Synthetic oligonucleotide
  Target: ANGPTL3; (+) strand; PAM type: YTN; PAM sequence: TTG
cctttttcattaaaagcatt

SEQ ID NO: 13812 - DNA, 20 bp, Artificial Sequence
  Description of Artificial Sequence: Synthetic oligonucleotide
  Target: ANGPTL3; (+) strand; PAM type: YTN; PAM sequence: CTT
tttcattaaaagcatttgta

SEQ ID NO: 13813 - DNA, 20 bp, Artificial Sequence
  Description of Artificial Sequence: Synthetic oligonucleotide
  Target: ANGPTL3; (+) strand; PAM type: YTN; PAM sequence: TTT
ttcattaaaagcatttgtaa

SEQ ID NO: 13814 - DNA, 20 bp, Artificial Sequence
  Description of Artificial Sequence: Synthetic oligonucleotide
  Target: ANGPTL3; (+) strand; PAM type: YTN; PAM sequence: TTT
tcattaaaagcatttgtaaa

SEQ ID NO: 13815 - DNA, 20 bp, Artificial Sequence
  Description of Artificial Sequence: Synthetic oligonucleotide
  Target: ANGPTL3; (+) strand; PAM type: YTN; PAM sequence: TTT
cattaaaagcatttgtaaaa

SEQ ID NO: 13816 - DNA, 20 bp, Artificial Sequence
  Description of Artificial Sequence: Synthetic oligonucleotide
  Target: ANGPTL3; (+) strand; PAM type: YTN; PAM sequence: TTC
attaaaagcatttgtaaaag

SEQ ID NO: 13817 - DNA, 20 bp, Artificial Sequence
  Description of Artificial Sequence: Synthetic oligonucleotide
  Target: ANGPTL3; (+) strand; PAM type: YTN; PAM sequence: TTA
aaagcatttgtaaaaggata

SEQ ID NO: 13818 - DNA, 20 bp, Artificial Sequence
  Description of Artificial Sequence: Synthetic oligonucleotide
  Target: ANGPTL3; (+) strand; PAM type: YTN; PAM sequence: TTT
gtaaaaggatataggaaaag

SEQ ID NO: 13819 - DNA, 20 bp, Artificial Sequence
  Description of Artificial Sequence: Synthetic oligonucleotide
  Target: ANGPTL3; (+) strand; PAM type: YTN; PAM sequence: TTG
taaaaggatataggaaaaga

SEQ ID NO: 13820 - DNA, 20 bp, Artificial Sequence
  Description of Artificial Sequence: Synthetic oligonucleotide
  Target: ANGPTL3; (+) strand; PAM type: YTN; PAM sequence: CTC
tcatatactcctggcaggga

SEQ ID NO: 13821 - DNA, 20 bp, Artificial Sequence
  Description of Artificial Sequence: Synthetic oligonucleotide
  Target: ANGPTL3; (+) strand; PAM type: YTN; PAM sequence: CTC
atatactcctggcagggatg

SEQ ID NO: 13822 - DNA, 20 bp, Artificial Sequence
  Description of Artificial Sequence: Synthetic oligonucleotide
  Target: ANGPTL3; (+) strand; PAM type: YTN; PAM sequence: CTC
ctggcagggatgtaaattgg

SEQ ID NO: 13823 - DNA, 20 bp, Artificial Sequence
  Description of Artificial Sequence: Synthetic oligonucleotide
  Target: ANGPTL3; (+) strand; PAM type: YTN; PAM sequence: CTG
gcagggatgtaaattggtac

SEQ ID NO: 13824 - DNA, 20 bp, Artificial Sequence
  Description of Artificial Sequence: Synthetic oligonucleotide
  Target: ANGPTL3; (+) strand; PAM type: YTN; PAM sequence: TTG
gtacaacccttttgaaggac

SEQ ID NO: 13825 - DNA, 20 bp, Artificial Sequence
  Description of Artificial Sequence: Synthetic oligonucleotide
  Target: ANGPTL3; (+) strand; PAM type: YTN; PAM sequence: CTT
ttgaaggacaatctgacaaa

SEQ ID NO: 13826 - DNA, 20 bp, Artificial Sequence
  Description of Artificial Sequence: Synthetic oligonucleotide
  Target: ANGPTL3; (+) strand; PAM type: YTN; PAM sequence: TTT
tgaaggacaatctgacaaaa

SEQ ID NO: 13827 - DNA, 20 bp, Artificial Sequence
  Description of Artificial Sequence: Synthetic oligonucleotide
  Target: ANGPTL3; (+) strand; PAM type: YTN; PAM sequence: TTT
gaaggacaatctgacaaaag

SEQ ID NO: 13828 - DNA, 20 bp, Artificial Sequence
  Description of Artificial Sequence: Synthetic oligonucleotide
  Target: ANGPTL3; (+) strand; PAM type: YTN; PAM sequence: TTG
aaggacaatctgacaaaagc

SEQ ID NO: 13829 - DNA, 20 bp, Artificial Sequence
  Description of Artificial Sequence: Synthetic oligonucleotide
  Target: ANGPTL3; (+) strand; PAM type: YTN; PAM sequence: CTG
acaaaagcaatcgtaagtta

SEQ ID NO: 13830 - DNA, 20 bp, Artificial Sequence
  Description of Artificial Sequence: Synthetic oligonucleotide
  Target: ANGPTL3; (+) strand; PAM type: YTN; PAM sequence: TTA
caagtcaacatctatgaatg

SEQ ID NO: 13831 - DNA, 20 bp, Artificial Sequence
  Description of Artificial Sequence: Synthetic oligonucleotide
  Target: ANGPTL3; (+) strand; PAM type: YTN; PAM sequence: CTA
tgaatgtatatgaaaatatt

SEQ ID NO: 13832 - DNA, 20 bp, Artificial Sequence
  Description of Artificial Sequence: Synthetic oligonucleotide
  Target: ANGPTL3; (+) strand; PAM type: YTN; PAM sequence: TTT
atatacatacatcaccacca

SEQ ID NO: 13833 - DNA, 20 bp, Artificial Sequence
  Description of Artificial Sequence: Synthetic oligonucleotide
  Target: ANGPTL3; (+) strand; PAM type: YTN; PAM sequence: TTA
tatacatacatcaccaccat

SEQ ID NO: 13834 - DNA, 20 bp, Artificial Sequence
  Description of Artificial Sequence: Synthetic oligonucleotide
  Target: ANGPTL3; (+) strand; PAM type: YTN; PAM sequence: TTT
tctatacatactgtttataa

SEQ ID NO: 13835 - DNA, 20 bp, Artificial Sequence
  Description of Artificial Sequence: Synthetic oligonucleotide
  Target: ANGPTL3; (+) strand; PAM type: YTN; PAM sequence: TTT
ctatacatactgtttataat

SEQ ID NO: 13836 - DNA, 20 bp, Artificial Sequence
  Description of Artificial Sequence: Synthetic oligonucleotide
  Target: ANGPTL3; (+) strand; PAM type: YTN; PAM sequence: TTC
tatacatactgtttataatt

SEQ ID NO: 13837 - DNA, 20 bp, Artificial Sequence
  Description of Artificial Sequence: Synthetic oligonucleotide
  Target: ANGPTL3; (+) strand; PAM type: YTN; PAM sequence: CTA
tacatactgtttataattag

SEQ ID NO: 13838 - DNA, 20 bp, Artificial Sequence
  Description of Artificial Sequence: Synthetic oligonucleotide
  Target: ANGPTL3; (+) strand; PAM type: YTN; PAM sequence: CTG
tttataattagaaaattgga

SEQ ID NO: 13839 - DNA, 20 bp, Artificial Sequence
  Description of Artificial Sequence: Synthetic oligonucleotide
  Target: ANGPTL3; (+) strand; PAM type: YTN; PAM sequence: TTT
ataattagaaaattggaaac

SEQ ID NO: 13840 - DNA, 20 bp, Artificial Sequence
  Description of Artificial Sequence: Synthetic oligonucleotide
  Target: ANGPTL3; (+) strand; PAM type: YTN; PAM sequence: TTA
taattagaaaattggaaaca

SEQ ID NO: 13841 - DNA, 20 bp, Artificial Sequence
  Description of Artificial Sequence: Synthetic oligonucleotide
  Target: ANGPTL3; (+) strand; PAM type: YTN; PAM sequence: TTA
gaaaattggaaacaaatgat

SEQ ID NO: 13842 - DNA, 20 bp, Artificial Sequence
  Description of Artificial Sequence: Synthetic oligonucleotide
  Target: ANGPTL3; (+) strand; PAM type: YTN; PAM sequence: TTG
gaaacaaatgattaaaaggg

SEQ ID NO: 13843 - DNA, 20 bp, Artificial Sequence
  Description of Artificial Sequence: Synthetic oligonucleotide
  Target: ANGPTL3; (+) strand; PAM type: YTN; PAM sequence: TTA
aaagggggctgattaaatta

SEQ ID NO: 13844 - DNA, 20 bp, Artificial Sequence
  Description of Artificial Sequence: Synthetic oligonucleotide
  Target: ANGPTL3; (+) strand; PAM type: YTN; PAM sequence: CTG
attaaattaaggttcatcta

SEQ ID NO: 13845 - DNA, 20 bp, Artificial Sequence
  Description of Artificial Sequence: Synthetic oligonucleotide
  Target: ANGPTL3; (+) strand; PAM type: YTN; PAM sequence: TTA
aattaaggttcatctatata

SEQ ID NO: 13846 - DNA, 20 bp, Artificial Sequence
  Description of Artificial Sequence: Synthetic oligonucleotide
  Target: ANGPTL3; (+) strand; PAM type: YTN; PAM sequence: TTA
aggttcatctatataacagg

SEQ ID NO: 13847 - DNA, 20 bp, Artificial Sequence
  Description of Artificial Sequence: Synthetic oligonucleotide
  Target: ANGPTL3; (+) strand; PAM type: YTN; PAM sequence: TTC
atctatataacaggattatg

SEQ ID NO: 13848 - DNA, 20 bp, Artificial Sequence
  Description of Artificial Sequence: Synthetic oligonucleotide
  Target: ANGPTL3; (+) strand; PAM type: YTN; PAM sequence: CTA
tataacaggattatgcagct

SEQ ID NO: 13849 - DNA, 20 bp, Artificial Sequence
  Description of Artificial Sequence: Synthetic oligonucleotide
  Target: ANGPTL3; (+) strand; PAM type: YTN; PAM sequence: TTA
tgcagctattaaaaaggacg

SEQ ID NO: 13850 - DNA, 20 bp, Artificial Sequence
  Description of Artificial Sequence: Synthetic oligonucleotide
  Target: ANGPTL3; (+) strand; PAM type: YTN; PAM sequence: CTA
ttaaaaaggacgtggtaact

SEQ ID NO: 13851 - DNA, 20 bp, Artificial Sequence
  Description of Artificial Sequence: Synthetic oligonucleotide
  Target: ANGPTL3; (+) strand; PAM type: YTN; PAM sequence: TTA
aaaaggacgtggtaactcta

SEQ ID NO: 13852 - DNA, 20 bp, Artificial Sequence
  Description of Artificial Sequence: Synthetic oligonucleotide
  Target: ANGPTL3; (+) strand; PAM type: YTN; PAM sequence: CTC
tatagacattcataggaaaa

SEQ ID NO: 13853 - DNA, 20 bp, Artificial Sequence
  Description of Artificial Sequence: Synthetic oligonucleotide
  Target: ANGPTL3; (+) strand; PAM type: YTN; PAM sequence: CTA
tagacattcataggaaaata

SEQ ID NO: 13854 - DNA, 20 bp, Artificial Sequence
  Description of Artificial Sequence: Synthetic oligonucleotide
  Target: ANGPTL3; (+) strand; PAM type: YTN; PAM sequence: TTC
ataggaaaataaattttaaa

SEQ ID NO: 13855 - DNA, 20 bp, Artificial Sequence
  Description of Artificial Sequence: Synthetic oligonucleotide
  Target: ANGPTL3; (+) strand; PAM type: YTN; PAM sequence: TTT
taaaatactaagatcctgaa

SEQ ID NO: 13856 - DNA, 20 bp, Artificial Sequence
  Description of Artificial Sequence: Synthetic oligonucleotide
  Target: ANGPTL3; (+) strand; PAM type: YTN; PAM sequence: TTT
aaaatactaagatcctgaat

SEQ ID NO: 13857 - DNA, 20 bp, Artificial Sequence
  Description of Artificial Sequence: Synthetic oligonucleotide
  Target: ANGPTL3; (+) strand; PAM type: YTN; PAM sequence: TTA
aaatactaagatcctgaatg

SEQ ID NO: 13858 - DNA, 20 bp, Artificial Sequence
  Description of Artificial Sequence: Synthetic oligonucleotide
  Target: ANGPTL3; (+) strand; PAM type: YTN; PAM sequence: CTA
agatcctgaatgatatatat

SEQ ID NO: 13859 - DNA, 20 bp, Artificial Sequence
  Description of Artificial Sequence: Synthetic oligonucleotide
  Target: ANGPTL3; (+) strand; PAM type: YTN; PAM sequence: CTG
aatgatatatatatcatgag

SEQ ID NO: 13860 - DNA, 20 bp, Artificial Sequence
  Description of Artificial Sequence: Synthetic oligonucleotide
  Target: ANGPTL3; (+) strand; PAM type: YTN; PAM sequence: CTA
ttatacataacaagatccca

SEQ ID NO: 13861 - DNA, 20 bp, Artificial Sequence
  Description of Artificial Sequence: Synthetic oligonucleotide
  Target: ANGPTL3; (+) strand; PAM type: YTN; PAM sequence: TTA
tacataacaagatcccactt

SEQ ID NO: 13862 - DNA, 20 bp, Artificial Sequence
  Description of Artificial Sequence: Synthetic oligonucleotide
  Target: ANGPTL3; (+) strand; PAM type: YTN; PAM sequence: CTT
gtgttataaaaaattatgtt

SEQ ID NO: 13863 - DNA, 20 bp, Artificial Sequence
  Description of Artificial Sequence: Synthetic oligonucleotide
  Target: ANGPTL3; (+) strand; PAM type: YTN; PAM sequence: TTG
tgttataaaaaattatgttt

SEQ ID NO: 13864 - DNA, 20 bp, Artificial Sequence
  Description of Artificial Sequence: Synthetic oligonucleotide
  Target: ANGPTL3; (+) strand; PAM type: YTN; PAM sequence: TTA
taaaaaattatgtttagtca

SEQ ID NO: 13865 - DNA, 20 bp, Artificial Sequence
  Description of Artificial Sequence: Synthetic oligonucleotide
  Target: ANGPTL3; (+) strand; PAM type: YTN; PAM sequence: TTA
tgtttagtcattcaaagggt

SEQ ID NO: 13866 - DNA, 20 bp, Artificial Sequence
  Description of Artificial Sequence: Synthetic oligonucleotide
  Target: ANGPTL3; (+) strand; PAM type: YTN; PAM sequence: TTT
agtcattcaaagggtctggt

SEQ ID NO: 13867 - DNA, 20 bp, Artificial Sequence
  Description of Artificial Sequence: Synthetic oligonucleotide
  Target: ANGPTL3; (+) strand; PAM type: YTN; PAM sequence: TTA
gtcattcaaagggtctggta

SEQ ID NO: 13868 - DNA, 20 bp, Artificial Sequence
  Description of Artificial Sequence: Synthetic oligonucleotide
  Target: ANGPTL3; (+) strand; PAM type: YTN; PAM sequence: TTC
aaagggtctggtatgataga

SEQ ID NO: 13869 - DNA, 20 bp, Artificial Sequence
  Description of Artificial Sequence: Synthetic oligonucleotide
  Target: ANGPTL3; (+) strand; PAM type: YTN; PAM sequence: CTG
gtatgatagacccaaaatgt

SEQ ID NO: 13870 - DNA, 20 bp, Artificial Sequence
  Description of Artificial Sequence: Synthetic oligonucleotide
  Target: ANGPTL3; (+) strand; PAM type: YTN; PAM sequence: TTA
atagagtcgagatttttatt

SEQ ID NO: 13871 - DNA, 20 bp, Artificial Sequence
  Description of Artificial Sequence: Synthetic oligonucleotide
  Target: ANGPTL3; (+) strand; PAM type: YTN; PAM sequence: TTT
ttattttttataggtttttg

SEQ ID NO: 13872 - DNA, 20 bp, Artificial Sequence
  Description of Artificial Sequence: Synthetic oligonucleotide
  Target: ANGPTL3; (+) strand; PAM type: YTN; PAM sequence: TTT
tattttttataggtttttga

SEQ ID NO: 13873 - DNA, 20 bp, Artificial Sequence
  Description of Artificial Sequence: Synthetic oligonucleotide
  Target: ANGPTL3; (+) strand; PAM type: YTN; PAM sequence: TTT
attttttataggtttttgaa

SEQ ID NO: 13874 - DNA, 20 bp, Artificial Sequence
  Description of Artificial Sequence: Synthetic oligonucleotide
  Target: ANGPTL3; (+) strand; PAM type: YTN; PAM sequence: TTA
ttttttataggtttttgaaa

SEQ ID NO: 13875 - DNA, 20 bp, Artificial Sequence
  Description of Artificial Sequence: Synthetic oligonucleotide
  Target: ANGPTL3; (+) strand; PAM type: YTN; PAM sequence: TTT
tttataggtttttgaaatac

SEQ ID NO: 13876 - DNA, 20 bp, Artificial Sequence
  Description of Artificial Sequence: Synthetic oligonucleotide
  Target: ANGPTL3; (+) strand; PAM type: YTN; PAM sequence: TTT
ttataggtttttgaaatacc

SEQ ID NO: 13877 - DNA, 20 bp, Artificial Sequence
  Description of Artificial Sequence: Synthetic oligonucleotide
  Target: ANGPTL3; (+) strand; PAM type: YTN; PAM sequence: TTT
tataggtttttgaaatacct

SEQ ID NO: 13878 - DNA, 20 bp, Artificial Sequence
  Description of Artificial Sequence: Synthetic oligonucleotide
  Target: ANGPTL3; (+) strand; PAM type: YTN; PAM sequence: TTT
ataggtttttgaaatacctg

SEQ ID NO: 13879 - DNA, 20 bp, Artificial Sequence
  Description of Artificial Sequence: Synthetic oligonucleotide
  Target: ANGPTL3; (+) strand; PAM type: YTN; PAM sequence: TTA
taggtttttgaaatacctga

SEQ ID NO: 13880 - DNA, 20 bp, Artificial Sequence
  Description of Artificial Sequence: Synthetic oligonucleotide
  Target: ANGPTL3; (+) strand; PAM type: YTN; PAM sequence: TTT
ttgaaatacctgaattttca

SEQ ID NO: 13881 - DNA, 20 bp, Artificial Sequence
  Description of Artificial Sequence: Synthetic oligonucleotide
  Target: ANGPTL3; (+) strand; PAM type: YTN; PAM sequence: TTT
tgaaatacctgaattttcac

SEQ ID NO: 13882 - DNA, 20 bp, Artificial Sequence
  Description of Artificial Sequence: Synthetic oligonucleotide
  Target: ANGPTL3; (+) strand; PAM type: YTN; PAM sequence: TTT
gaaatacctgaattttcaca

SEQ ID NO: 13883 - DNA, 20 bp, Artificial Sequence
  Description of Artificial Sequence: Synthetic oligonucleotide
  Target: ANGPTL3; (+) strand; PAM type: YTN; PAM sequence: TTG
aaatacctgaattttcacaa

SEQ ID NO: 13884 - DNA, 20 bp, Artificial Sequence
  Description of Artificial Sequence: Synthetic oligonucleotide
  Target: ANGPTL3; (+) strand; PAM type: YTN; PAM sequence: CTG
aattttcacaataagtactt

SEQ ID NO: 13885 - DNA, 20 bp, Artificial Sequence
  Description of Artificial Sequence: Synthetic oligonucleotide
  Target: ANGPTL3; (+) strand; PAM type: YTN; PAM sequence: TTT
tcacaataagtactttgcac

SEQ ID NO: 13886 - DNA, 20 bp, Artificial Sequence
  Description of Artificial Sequence: Synthetic oligonucleotide
  Target: ANGPTL3; (+) strand; PAM type: YTN; PAM sequence: TTT
cacaataagtactttgcaca

SEQ ID NO: 13887 - DNA, 20 bp, Artificial Sequence
  Description of Artificial Sequence: Synthetic oligonucleotide
  Target: ANGPTL3; (+) strand; PAM type: YTN; PAM sequence: TTC
acaataagtactttgcacat

SEQ ID NO: 13888 - DNA, 20 bp, Artificial Sequence
  Description of Artificial Sequence: Synthetic oligonucleotide
  Target: ANGPTL3; (+) strand; PAM type: YTN; PAM sequence: CTT
tgcacattaaaaatcttagc

SEQ ID NO: 13889 - DNA, 20 bp, Artificial Sequence
  Description of Artificial Sequence: Synthetic oligonucleotide
  Target: ANGPTL3; (+) strand; PAM type: YTN; PAM sequence: TTT
gcacattaaaaatcttagct

SEQ ID NO: 13890 - DNA, 20 bp, Artificial Sequence
  Description of Artificial Sequence: Synthetic oligonucleotide
  Target: ANGPTL3; (+) strand; PAM type: YTN; PAM sequence: TTG
cacattaaaaatcttagctg

SEQ ID NO: 13891 - DNA, 20 bp, Artificial Sequence
  Description of Artificial Sequence: Synthetic oligonucleotide
  Target: ANGPTL3; (+) strand; PAM type: YTN; PAM sequence: TTA
aaaatcttagctgggcatgg

SEQ ID NO: 13892 - DNA, 20 bp, Artificial Sequence
  Description of Artificial Sequence: Synthetic oligonucleotide
  Target: ANGPTL3; (+) strand; PAM type: YTN; PAM sequence: CTT
agctgggcatggtggctcac

SEQ ID NO: 13893 - DNA, 20 bp, Artificial Sequence
  Description of Artificial Sequence: Synthetic oligonucleotide
  Target: ANGPTL3; (+) strand; PAM type: YTN; PAM sequence: TTA
gctgggcatggtggctcacg

SEQ ID NO: 13894 - DNA, 20 bp, Artificial Sequence
  Description of Artificial Sequence: Synthetic oligonucleotide
  Target: ANGPTL3; (+) strand; PAM type: YTN; PAM sequence: CTG
ggcatggtggctcacgcttg

SEQ ID NO: 13895 - DNA, 20 bp, Artificial Sequence
  Description of Artificial Sequence: Synthetic oligonucleotide
  Target: ANGPTL3; (+) strand; PAM type: YTN; PAM sequence: CTC
acgcttgtaatcccagcact

SEQ ID NO: 13896 - DNA, 20 bp, Artificial Sequence
  Description of Artificial Sequence: Synthetic oligonucleotide
  Target: ANGPTL3; (+) strand; PAM type: YTN; PAM sequence: CTT
gtaatcccagcactctggga

SEQ ID NO: 13897 - DNA, 20 bp, Artificial Sequence
  Description of Artificial Sequence: Synthetic oligonucleotide
  Target: ANGPTL3; (+) strand; PAM type: YTN; PAM sequence: TTG
taatcccagcactctgggag

SEQ ID NO: 13898 - DNA, 20 bp, Artificial Sequence
  Description of Artificial Sequence: Synthetic oligonucleotide
  Target: ANGPTL3; (+) strand; PAM type: YTN; PAM sequence: CTC
tgggaggccaaggtaggcag

SEQ ID NO: 13899 - DNA, 20 bp, Artificial Sequence
  Description of Artificial Sequence: Synthetic oligonucleotide
  Target: ANGPTL3; (+) strand; PAM type: YTN; PAM sequence: CTG
ggaggccaaggtaggcagat

SEQ ID NO: 13900 - DNA, 20 bp, Artificial Sequence
  Description of Artificial Sequence: Synthetic oligonucleotide
  Target: ANGPTL3; (+) strand; PAM type: YTN; PAM sequence: CTG
aggtcaggagttcgagacca

SEQ ID NO: 13901 - DNA, 20 bp, Artificial Sequence
  Description of Artificial Sequence: Synthetic oligonucleotide
  Target: ANGPTL3; (+) strand; PAM type: YTN; PAM sequence: TTC
gagaccagtctggccaacat

SEQ ID NO: 13902 - DNA, 20 bp, Artificial Sequence
  Description of Artificial Sequence: Synthetic oligonucleotide
  Target: ANGPTL3; (+) strand; PAM type: YTN; PAM sequence: CTG
gccaacatggtgaaaccccg

SEQ ID NO: 13903 - DNA, 20 bp, Artificial Sequence
  Description of Artificial Sequence: Synthetic oligonucleotide
  Target: ANGPTL3; (+) strand; PAM type: YTN; PAM sequence: CTC
tactaaaaatacaaaaatta

SEQ ID NO: 13904 - DNA, 20 bp, Artificial Sequence
  Description of Artificial Sequence: Synthetic oligonucleotide
  Target: ANGPTL3; (+) strand; PAM type: YTN; PAM sequence: CTA
ctaaaaatacaaaaattagc

SEQ ID NO: 13905 - DNA, 20 bp, Artificial Sequence
  Description of Artificial Sequence: Synthetic oligonucleotide
  Target: ANGPTL3; (+) strand; PAM type: YTN; PAM sequence: CTA
aaaatacaaaaattagccag

SEQ ID NO: 13906 - DNA, 20 bp, Artificial Sequence
  Description of Artificial Sequence: Synthetic oligonucleotide
  Target: ANGPTL3; (+) strand; PAM type: YTN; PAM sequence: TTA
gccaggcttggttgggggtg

SEQ ID NO: 13907 - DNA, 20 bp, Artificial Sequence
  Description of Artificial Sequence: Synthetic oligonucleotide
  Target: ANGPTL3; (+) strand; PAM type: YTN; PAM sequence: CTT
ggttgggggtgcctgtaatt

SEQ ID NO: 13908 - DNA, 20 bp, Artificial Sequence
  Description of Artificial Sequence: Synthetic oligonucleotide
  Target: ANGPTL3; (+) strand; PAM type: YTN; PAM sequence: TTG
gttgggggtgcctgtaattc

SEQ ID NO: 13909 - DNA, 20 bp, Artificial Sequence
  Description of Artificial Sequence: Synthetic oligonucleotide
  Target: ANGPTL3; (+) strand; PAM type: YTN; PAM sequence: TTG
ggggtgcctgtaattccaga

SEQ ID NO: 13910 - DNA, 20 bp, Artificial Sequence
  Description of Artificial Sequence: Synthetic oligonucleotide
  Target: ANGPTL3; (+) strand; PAM type: YTN; PAM sequence: CTG
taattccagatactcgggaa

SEQ ID NO: 13911 - DNA, 20 bp, Artificial Sequence
  Description of Artificial Sequence: Synthetic oligonucleotide
  Target: ANGPTL3; (+) strand; PAM type: YTN; PAM sequence: TTC
cagatactcgggaagctgag

SEQ ID NO: 13912 - DNA, 20 bp, Artificial Sequence
  Description of Artificial Sequence: Synthetic oligonucleotide
  Target: ANGPTL3; (+) strand; PAM type: YTN; PAM sequence: CTC
gggaagctgagacaggagaa

SEQ ID NO: 13913 - DNA, 20 bp, Artificial Sequence
  Description of Artificial Sequence: Synthetic oligonucleotide
  Target: ANGPTL3; (+) strand; PAM type: YTN; PAM sequence: CTG
agacaggagaatcgcttgaa

SEQ ID NO: 13914 - DNA, 20 bp, Artificial Sequence
  Description of Artificial Sequence: Synthetic oligonucleotide
  Target: ANGPTL3; (+) strand; PAM type: YTN; PAM sequence: CTT
gaacccaggagggggaagtt

SEQ ID NO: 13915 - DNA, 20 bp, Artificial Sequence
  Description of Artificial Sequence: Synthetic oligonucleotide
  Target: ANGPTL3; (+) strand; PAM type: YTN; PAM sequence: TTG
aacccaggagggggaagttg

SEQ ID NO: 13916 - DNA, 20 bp, Artificial Sequence
  Description of Artificial Sequence: Synthetic oligonucleotide
  Target: ANGPTL3; (+) strand; PAM type: YTN; PAM sequence: TTG
cagtgagctgagatcacgac

SEQ ID NO: 13917 - DNA, 20 bp, Artificial Sequence
  Description of Artificial Sequence: Synthetic oligonucleotide
  Target: ANGPTL3; (+) strand; PAM type: YTN; PAM sequence: CTG
agatcacgacgctgcactcc

SEQ ID NO: 13918 - DNA, 20 bp, Artificial Sequence
  Description of Artificial Sequence: Synthetic oligonucleotide
  Target: ANGPTL3; (+) strand; PAM type: YTN; PAM sequence: CTG
cactccagcctgggcaacaa

SEQ ID NO: 13919 - DNA, 20 bp, Artificial Sequence
  Description of Artificial Sequence: Synthetic oligonucleotide
  Target: ANGPTL3; (+) strand; PAM type: YTN; PAM sequence: CTC
cagcctgggcaacaaagagc

SEQ ID NO: 13920 - DNA, 20 bp, Artificial Sequence
  Description of Artificial Sequence: Synthetic oligonucleotide
  Target: ANGPTL3; (+) strand; PAM type: YTN; PAM sequence: CTG
ggcaacaaagagcaaaactc

SEQ ID NO: 13921 - DNA, 20 bp, Artificial Sequence
  Description of Artificial Sequence: Synthetic oligonucleotide
  Target: ANGPTL3; (+) strand; PAM type: YTN; PAM sequence: CTC
cgtctcaaaaataaataaag

SEQ ID NO: 13922 - DNA, 20 bp, Artificial Sequence
  Description of Artificial Sequence: Synthetic oligonucleotide
  Target: ANGPTL3; (+) strand; PAM type: YTN; PAM sequence: CTC
aaaaataaataaagaaaaaa

SEQ ID NO: 13923 - DNA, 20 bp, Artificial Sequence
  Description of Artificial Sequence: Synthetic oligonucleotide
  Target: ANGPTL3; (+) strand; PAM type: YTN; PAM sequence: CTT
tacatgtccaaagatacggc

SEQ ID NO: 13924 - DNA, 20 bp, Artificial Sequence
  Description of Artificial Sequence: Synthetic oligonucleotide
  Target: ANGPTL3; (+) strand; PAM type: YTN; PAM sequence: TTT
acatgtccaaagatacggct

SEQ ID NO: 13925 - DNA, 20 bp, Artificial Sequence
  Description of Artificial Sequence: Synthetic oligonucleotide
  Target: ANGPTL3; (+) strand; PAM type: YTN; PAM sequence: TTA
catgtccaaagatacggctg

SEQ ID NO: 13926 - DNA, 20 bp, Artificial Sequence
  Description of Artificial Sequence: Synthetic oligonucleotide
  Target: ANGPTL3; (+) strand; PAM type: YTN; PAM sequence: CTG
ttcaactaaaaaatatatat

SEQ ID NO: 13927 - DNA, 20 bp, Artificial Sequence
  Description of Artificial Sequence: Synthetic oligonucleotide
  Target: ANGPTL3; (+) strand; PAM type: YTN; PAM sequence: TTC
aactaaaaaatatatatgta

SEQ ID NO: 13928 - DNA, 20 bp, Artificial Sequence
  Description of Artificial Sequence: Synthetic oligonucleotide
  Target: ANGPTL3; (+) strand; PAM type: YTN; PAM sequence: CTA
aaaaatatatatgtataaaa

SEQ ID NO: 13929 - DNA, 20 bp, Artificial Sequence
  Description of Artificial Sequence: Synthetic oligonucleotide
  Target: ANGPTL3; (+) strand; PAM type: YTN; PAM sequence: CTT
aacatgttaatagtgaacac

SEQ ID NO: 13930 - DNA, 20 bp, Artificial Sequence
  Description of Artificial Sequence: Synthetic oligonucleotide
  Target: ANGPTL3; (+) strand; PAM type: YTN; PAM sequence: TTA
acatgttaatagtgaacaca

SEQ ID NO: 13931 - DNA, 20 bp, Artificial Sequence
  Description of Artificial Sequence: Synthetic oligonucleotide
  Target: ANGPTL3; (+) strand; PAM type: YTN; PAM sequence: TTA
atagtgaacacacaaaacag

SEQ ID NO: 13932 - DNA, 20 bp, Artificial Sequence
  Description of Artificial Sequence: Synthetic oligonucleotide
  Target: ANGPTL3; (+) strand; PAM type: YTN; PAM sequence: TTA
ttccttcaaagctcacttaa

SEQ ID NO: 13933 - DNA, 20 bp, Artificial Sequence
  Description of Artificial Sequence: Synthetic oligonucleotide
  Target: ANGPTL3; (+) strand; PAM type: YTN; PAM sequence: TTC
cttcaaagctcacttaacct

SEQ ID NO: 13934 - DNA, 20 bp, Artificial Sequence
  Description of Artificial Sequence: Synthetic oligonucleotide
  Target: ANGPTL3; (+) strand; PAM type: YTN; PAM sequence: CTT
caaagctcacttaacctctg

SEQ ID NO: 13935 - DNA, 20 bp, Artificial Sequence
  Description of Artificial Sequence: Synthetic oligonucleotide
  Target: ANGPTL3; (+) strand; PAM type: YTN; PAM sequence: TTC
aaagctcacttaacctctgg

SEQ ID NO: 13936 - DNA, 20 bp, Artificial Sequence
  Description of Artificial Sequence: Synthetic oligonucleotide
  Target: ANGPTL3; (+) strand; PAM type: YTN; PAM sequence: CTC
acttaacctctggatctaca

SEQ ID NO: 13937 - DNA, 20 bp, Artificial Sequence
  Description of Artificial Sequence: Synthetic oligonucleotide
  Target: ANGPTL3; (+) strand; PAM type: YTN; PAM sequence: CTT
aacctctggatctacactgt

SEQ ID NO: 13938 - DNA, 20 bp, Artificial Sequence
  Description of Artificial Sequence: Synthetic oligonucleotide
  Target: ANGPTL3; (+) strand; PAM type: YTN; PAM sequence: TTA
acctctggatctacactgtc

SEQ ID NO: 13939 - DNA, 20 bp, Artificial Sequence
  Description of Artificial Sequence: Synthetic oligonucleotide
  Target: ANGPTL3; (+) strand; PAM type: YTN; PAM sequence: CTC
tggatctacactgtccaaaa

SEQ ID NO: 13940 - DNA, 20 bp, Artificial Sequence
  Description of Artificial Sequence: Synthetic oligonucleotide
  Target: ANGPTL3; (+) strand; PAM type: YTN; PAM sequence: CTG
gatctacactgtccaaaaag

SEQ ID NO: 13941 - DNA, 20 bp, Artificial Sequence
  Description of Artificial Sequence: Synthetic oligonucleotide
  Target: ANGPTL3; (+) strand; PAM type: YTN; PAM sequence: CTA
cactgtccaaaaagacggtc

SEQ ID NO: 13942 - DNA, 20 bp, Artificial Sequence
  Description of Artificial Sequence: Synthetic oligonucleotide
  Target: ANGPTL3; (+) strand; PAM type: YTN; PAM sequence: CTG
tccaaaaagacggtctaatg

SEQ ID NO: 13943 - DNA, 20 bp, Artificial Sequence
  Description of Artificial Sequence: Synthetic oligonucleotide
  Target: ANGPTL3; (+) strand; PAM type: YTN; PAM sequence: CTA
atgagacaattgagcacttg

SEQ ID NO: 13944 - DNA, 20 bp, Artificial Sequence
  Description of Artificial Sequence: Synthetic oligonucleotide
  Target: ANGPTL3; (+) strand; PAM type: YTN; PAM sequence: TTG
agcacttgataggtgagtgg

SEQ ID NO: 13945 - DNA, 20 bp, Artificial Sequence
  Description of Artificial Sequence: Synthetic oligonucleotide
  Target: ANGPTL3; (+) strand; PAM type: YTN; PAM sequence: CTT
gataggtgagtggttctaac

SEQ ID NO: 13946 - DNA, 20 bp, Artificial Sequence
  Description of Artificial Sequence: Synthetic oligonucleotide
  Target: ANGPTL3; (+) strand; PAM type: YTN; PAM sequence: TTG
ataggtgagtggttctaact

SEQ ID NO: 13947 - DNA, 20 bp, Artificial Sequence
  Description of Artificial Sequence: Synthetic oligonucleotide
  Target: ANGPTL3; (+) strand; PAM type: YTN; PAM sequence: TTC
taactgagatatgttctcag

SEQ ID NO: 13948 - DNA, 20 bp, Artificial Sequence
  Description of Artificial Sequence: Synthetic oligonucleotide
  Target: ANGPTL3; (+) strand; PAM type: YTN; PAM sequence: CTA
actgagatatgttctcagta

SEQ ID NO: 13949 - DNA, 20 bp, Artificial Sequence
  Description of Artificial Sequence: Synthetic oligonucleotide
  Target: ANGPTL3; (+) strand; PAM type: YTN; PAM sequence: CTG
agatatgttctcagtataaa

SEQ ID NO: 13950 - DNA, 20 bp, Artificial Sequence
  Description of Artificial Sequence: Synthetic oligonucleotide
  Target: ANGPTL3; (+) strand; PAM type: YTN; PAM sequence: TTC
tcagtataaaacatacaata

SEQ ID NO: 13951 - DNA, 20 bp, Artificial Sequence
  Description of Artificial Sequence: Synthetic oligonucleotide
  Target: ANGPTL3; (+) strand; PAM type: YTN; PAM sequence: CTC
agtataaaacatacaatagg

SEQ ID NO: 13952 - DNA, 20 bp, Artificial Sequence
  Description of Artificial Sequence: Synthetic oligonucleotide
  Target: ANGPTL3; (+) strand; PAM type: YTN; PAM sequence: CTT
cctatacaacattaattaaa

SEQ ID NO: 13953 - DNA, 20 bp, Artificial Sequence
  Description of Artificial Sequence: Synthetic oligonucleotide
  Target: ANGPTL3; (+) strand; PAM type: YTN; PAM sequence: TTC
ctatacaacattaattaaaa

SEQ ID NO: 13954 - DNA, 20 bp, Artificial Sequence
  Description of Artificial Sequence: Synthetic oligonucleotide
  Target: ANGPTL3; (+) strand; PAM type: YTN; PAM sequence: CTA
tacaacattaattaaaaaac

SEQ ID NO: 13955 - DNA, 20 bp, Artificial Sequence
  Description of Artificial Sequence: Synthetic oligonucleotide
  Target: ANGPTL3; (+) strand; PAM type: YTN; PAM sequence: TTA
attaaaaaacaaactattgt

SEQ ID NO: 13956 - DNA, 20 bp, Artificial Sequence
  Description of Artificial Sequence: Synthetic oligonucleotide
  Target: ANGPTL3; (+) strand; PAM type: YTN; PAM sequence: TTA
aaaaacaaactattgtagtt

SEQ ID NO: 13957 - DNA, 20 bp, Artificial Sequence
  Description of Artificial Sequence: Synthetic oligonucleotide
  Target: ANGPTL3; (+) strand; PAM type: YTN; PAM sequence: CTA
ttgtagttaaaaaggaaaaa

SEQ ID NO: 13958 - DNA, 20 bp, Artificial Sequence
  Description of Artificial Sequence: Synthetic oligonucleotide
  Target: ANGPTL3; (+) strand; PAM type: YTN; PAM sequence: TTG
tagttaaaaaggaaaaaatt

SEQ ID NO: 13959 - DNA, 20 bp, Artificial Sequence
  Description of Artificial Sequence: Synthetic oligonucleotide
  Target: ANGPTL3; (+) strand; PAM type: YTN; PAM sequence: TTA
aaaaggaaaaaattagagat

SEQ ID NO: 13960 - DNA, 20 bp, Artificial Sequence
  Description of Artificial Sequence: Synthetic oligonucleotide
  Target: ANGPTL3; (+) strand; PAM type: YTN; PAM sequence: TTA
gagatactatgtaaaaaaga

SEQ ID NO: 13961 - DNA, 20 bp, Artificial Sequence
  Description of Artificial Sequence: Synthetic oligonucleotide
  Target: ANGPTL3; (+) strand; PAM type: YTN; PAM sequence: CTA
tgtaaaaaagagccaaaata

SEQ ID NO: 13962 - DNA, 20 bp, Artificial Sequence
  Description of Artificial Sequence: Synthetic oligonucleotide
  Target: ANGPTL3; (+) strand; PAM type: YTN; PAM sequence: CTT
gtattttatttgaaagacat

SEQ ID NO: 13963 - DNA, 20 bp, Artificial Sequence
  Description of Artificial Sequence: Synthetic oligonucleotide
  Target: ANGPTL3; (+) strand; PAM type: YTN; PAM sequence: TTG
tattttatttgaaagacata

SEQ ID NO: 13964 - DNA, 20 bp, Artificial Sequence
  Description of Artificial Sequence: Synthetic oligonucleotide
  Target: ANGPTL3; (+) strand; PAM type: YTN; PAM sequence: TTT
tatttgaaagacatatctcc

SEQ ID NO: 13965 - DNA, 20 bp, Artificial Sequence
  Description of Artificial Sequence: Synthetic oligonucleotide
  Target: ANGPTL3; (+) strand; PAM type: YTN; PAM sequence: TTT
atttgaaagacatatctcca

SEQ ID NO: 13966 - DNA, 20 bp, Artificial Sequence
  Description of Artificial Sequence: Synthetic oligonucleotide
  Target: ANGPTL3; (+) strand; PAM type: YTN; PAM sequence: TTA
tttgaaagacatatctccat

SEQ ID NO: 13967 - DNA, 20 bp, Artificial Sequence
  Description of Artificial Sequence: Synthetic oligonucleotide
  Target: ANGPTL3; (+) strand; PAM type: YTN; PAM sequence: TTT
gaaagacatatctccataag

SEQ ID NO: 13968 - DNA, 20 bp, Artificial Sequence
  Description of Artificial Sequence: Synthetic oligonucleotide
  Target: ANGPTL3; (+) strand; PAM type: YTN; PAM sequence: TTG
aaagacatatctccataaga

SEQ ID NO: 13969 - DNA, 20 bp, Artificial Sequence
  Description of Artificial Sequence: Synthetic oligonucleotide
  Target: ANGPTL3; (+) strand; PAM type: YTN; PAM sequence: CTC
cataagattacacaacctcg

SEQ ID NO: 13970 - DNA, 20 bp, Artificial Sequence
  Description of Artificial Sequence: Synthetic oligonucleotide
  Target: ANGPTL3; (+) strand; PAM type: YTN; PAM sequence: TTA
cacaacctcgtgtaggataa

SEQ ID NO: 13971 - DNA, 20 bp, Artificial Sequence
  Description of Artificial Sequence: Synthetic oligonucleotide
  Target: ANGPTL3; (+) strand; PAM type: YTN; PAM sequence: CTC
gtgtaggataaaggactttg

SEQ ID NO: 13972 - DNA, 20 bp, Artificial Sequence
  Description of Artificial Sequence: Synthetic oligonucleotide
  Target: ANGPTL3; (+) strand; PAM type: YTN; PAM sequence: CTT
tgctttgcttggaatttaaa

SEQ ID NO: 13973 - DNA, 20 bp, Artificial Sequence
  Description of Artificial Sequence: Synthetic oligonucleotide
  Target: ANGPTL3; (+) strand; PAM type: YTN; PAM sequence: TTT
gctttgcttggaatttaaac

SEQ ID NO: 13974 - DNA, 20 bp, Artificial Sequence
  Description of Artificial Sequence: Synthetic oligonucleotide
  Target: ANGPTL3; (+) strand; PAM type: YTN; PAM sequence: TTG
ctttgcttggaatttaaaca

SEQ ID NO: 13975 - DNA, 20 bp, Artificial Sequence
  Description of Artificial Sequence: Synthetic oligonucleotide
  Target: ANGPTL3; (+) strand; PAM type: YTN; PAM sequence: CTT
tgcttggaatttaaacaatt

SEQ ID NO: 13976 - DNA, 20 bp, Artificial Sequence
  Description of Artificial Sequence: Synthetic oligonucleotide
  Target: ANGPTL3; (+) strand; PAM type: YTN; PAM sequence: TTT
gcttggaatttaaacaattt

SEQ ID NO: 13977 - DNA, 20 bp, Artificial Sequence
  Description of Artificial Sequence: Synthetic oligonucleotide
  Target: ANGPTL3; (+) strand; PAM type: YTN; PAM sequence: TTG
cttggaatttaaacaattta

SEQ ID NO: 13978 - DNA, 20 bp, Artificial Sequence
  Description of Artificial Sequence: Synthetic oligonucleotide
  Target: ANGPTL3; (+) strand; PAM type: YTN; PAM sequence: CTT
ggaatttaaacaatttaggc

SEQ ID NO: 13979 - DNA, 20 bp, Artificial Sequence
  Description of Artificial Sequence: Synthetic oligonucleotide
  Target: ANGPTL3; (+) strand; PAM type: YTN; PAM sequence: TTG
gaatttaaacaatttaggct

SEQ ID NO: 13980 - DNA, 20 bp, Artificial Sequence
  Description of Artificial Sequence: Synthetic oligonucleotide
  Target: ANGPTL3; (+) strand; PAM type: YTN; PAM sequence: TTT
aaacaatttaggctcttaaa

SEQ ID NO: 13981 - DNA, 20 bp, Artificial Sequence
  Description of Artificial Sequence: Synthetic oligonucleotide
  Target: ANGPTL3; (+) strand; PAM type: YTN; PAM sequence: TTA
aacaatttaggctcttaaat

SEQ ID NO: 13982 - DNA, 20 bp, Artificial Sequence
  Description of Artificial Sequence: Synthetic oligonucleotide
  Target: ANGPTL3; (+) strand; PAM type: YTN; PAM sequence: TTT
aggctcttaaatgtcctaaa

SEQ ID NO: 13983 - DNA, 20 bp, Artificial Sequence
  Description of Artificial Sequence: Synthetic oligonucleotide
  Target: ANGPTL3; (+) strand; PAM type: YTN; PAM sequence: TTA
ggctcttaaatgtcctaaaa

SEQ ID NO: 13984 - DNA, 20 bp, Artificial Sequence
  Description of Artificial Sequence: Synthetic oligonucleotide
  Target: ANGPTL3; (+) strand; PAM type: YTN; PAM sequence: CTC
ttaaatgtcctaaaattctc

SEQ ID NO: 13985 - DNA, 20 bp, Artificial Sequence
  Description of Artificial Sequence: Synthetic oligonucleotide
  Target: ANGPTL3; (+) strand; PAM type: YTN; PAM sequence: CTT
aaatgtcctaaaattctctg

SEQ ID NO: 13986 - DNA, 20 bp, Artificial Sequence
  Description of Artificial Sequence: Synthetic oligonucleotide
  Target: ANGPTL3; (+) strand; PAM type: YTN; PAM sequence: TTA
aatgtcctaaaattctctgt

SEQ ID NO: 13987 - DNA, 20 bp, Artificial Sequence
  Description of Artificial Sequence: Synthetic oligonucleotide
  Target: ANGPTL3; (+) strand; PAM type: YTN; PAM sequence: CTA
aaattctctgtagctaagaa

SEQ ID NO: 13988 - DNA, 20 bp, Artificial Sequence
  Description of Artificial Sequence: Synthetic oligonucleotide
  Target: ANGPTL3; (+) strand; PAM type: YTN; PAM sequence: TTC
tctgtagctaagaaattttt

SEQ ID NO: 13989 - DNA, 20 bp, Artificial Sequence
  Description of Artificial Sequence: Synthetic oligonucleotide
  Target: ANGPTL3; (+) strand; PAM type: YTN; PAM sequence: CTC
tgtagctaagaaatttttat

SEQ ID NO: 13990 - DNA, 20 bp, Artificial Sequence
  Description of Artificial Sequence: Synthetic oligonucleotide
  Target: ANGPTL3; (+) strand; PAM type: YTN; PAM sequence: CTG
tagctaagaaatttttatat

SEQ ID NO: 13991 - DNA, 20 bp, Artificial Sequence
  Description of Artificial Sequence: Synthetic oligonucleotide
  Target: ANGPTL3; (+) strand; PAM type: YTN; PAM sequence: CTA
agaaatttttatattggttc

SEQ ID NO: 13992 - DNA, 20 bp, Artificial Sequence
  Description of Artificial Sequence: Synthetic oligonucleotide
  Target: ANGPTL3; (+) strand; PAM type: YTN; PAM sequence: TTT
ttatattggttcctaggaac

SEQ ID NO: 13993 - DNA, 20 bp, Artificial Sequence
  Description of Artificial Sequence: Synthetic oligonucleotide
  Target: ANGPTL3; (+) strand; PAM type: YTN; PAM sequence: TTT
tatattggttcctaggaact

SEQ ID NO: 13994 - DNA, 20 bp, Artificial Sequence
  Description of Artificial Sequence: Synthetic oligonucleotide
  Target: ANGPTL3; (+) strand; PAM type: YTN; PAM sequence: TTT
atattggttcctaggaacta

SEQ ID NO: 13995 - DNA, 20 bp, Artificial Sequence
  Description of Artificial Sequence: Synthetic oligonucleotide
  Target: ANGPTL3; (+) strand; PAM type: YTN; PAM sequence: TTA
tattggttcctaggaactag

SEQ ID NO: 13996 - DNA, 20 bp, Artificial Sequence
  Description of Artificial Sequence: Synthetic oligonucleotide
  Target: ANGPTL3; (+) strand; PAM type: YTN; PAM sequence: TTG
gttcctaggaactaggaatc

SEQ ID NO: 13997 - DNA, 20 bp, Artificial Sequence
  Description of Artificial Sequence: Synthetic oligonucleotide
  Target: ANGPTL3; (+) strand; PAM type: YTN; PAM sequence: TTC
ctaggaactaggaatcctta

SEQ ID NO: 13998 - DNA, 20 bp, Artificial Sequence
  Description of Artificial Sequence: Synthetic oligonucleotide
  Target: ANGPTL3; (+) strand; PAM type: YTN; PAM sequence: CTA
ggaactaggaatccttaaat

SEQ ID NO: 13999 - DNA, 20 bp, Artificial Sequence
  Description of Artificial Sequence: Synthetic oligonucleotide
  Target: ANGPTL3; (+) strand; PAM type: YTN; PAM sequence: CTA
ggaatccttaaattaggccc

SEQ ID NO: 14000 - DNA, 20 bp, Artificial Sequence
  Description of Artificial Sequence: Synthetic oligonucleotide
  Target: ANGPTL3; (+) strand; PAM type: YTN; PAM sequence: CTT
aaattaggccctacatttgc

SEQ ID NO: 14001 - DNA, 20 bp, Artificial Sequence
  Description of Artificial Sequence: Synthetic oligonucleotide
  Target: ANGPTL3; (+) strand; PAM type: YTN; PAM sequence: TTA
aattaggccctacatttgct

SEQ ID NO: 14002 - DNA, 20 bp, Artificial Sequence
  Description of Artificial Sequence: Synthetic oligonucleotide
  Target: ANGPTL3; (+) strand; PAM type: YTN; PAM sequence: TTA
ggccctacatttgcttacaa

SEQ ID NO: 14003 - DNA, 20 bp, Artificial Sequence
  Description of Artificial Sequence: Synthetic oligonucleotide
  Target: ANGPTL3; (+) strand; PAM type: YTN; PAM sequence: CTA
catttgcttacaagtttatt

SEQ ID NO: 14004 - DNA, 20 bp, Artificial Sequence
  Description of Artificial Sequence: Synthetic oligonucleotide
  Target: ANGPTL3; (+) strand; PAM type: YTN; PAM sequence: TTT
gcttacaagtttattttcct

SEQ ID NO: 14005 - DNA, 20 bp, Artificial Sequence
  Description of Artificial Sequence: Synthetic oligonucleotide
  Target: ANGPTL3; (+) strand; PAM type: YTN; PAM sequence: TTG
cttacaagtttattttcctt

SEQ ID NO: 14006 - DNA, 20 bp, Artificial Sequence
  Description of Artificial Sequence: Synthetic oligonucleotide
  Target: ANGPTL3; (+) strand; PAM type: YTN; PAM sequence: CTT
acaagtttattttccttggc

SEQ ID NO: 14007 - DNA, 20 bp, Artificial Sequence
  Description of Artificial Sequence: Synthetic oligonucleotide
  Target: ANGPTL3; (+) strand; PAM type: YTN; PAM sequence: TTA
caagtttattttccttggca

SEQ ID NO: 14008 - DNA, 20 bp, Artificial Sequence
  Description of Artificial Sequence: Synthetic oligonucleotide
  Target: ANGPTL3; (+) strand; PAM type: YTN; PAM sequence: TTT
attttccttggcataaaatt

SEQ ID NO: 14009 - DNA, 20 bp, Artificial Sequence
  Description of Artificial Sequence: Synthetic oligonucleotide
  Target: ANGPTL3; (+) strand; PAM type: YTN; PAM sequence: TTA
ttttccttggcataaaattt

SEQ ID NO: 14010 - DNA, 20 bp, Artificial Sequence
  Description of Artificial Sequence: Synthetic oligonucleotide
  Target: ANGPTL3; (+) strand; PAM type: YTN; PAM sequence: TTT
tccttggcataaaatttttt

SEQ ID NO: 14011 - DNA, 20 bp, Artificial Sequence
  Description of Artificial Sequence: Synthetic oligonucleotide
  Target: ANGPTL3; (+) strand; PAM type: YTN; PAM sequence: TTT
ccttggcataaaatttttta

SEQ ID NO: 14012 - DNA, 20 bp, Artificial Sequence
  Description of Artificial Sequence: Synthetic oligonucleotide
  Target: ANGPTL3; (+) strand; PAM type: YTN; PAM sequence: TTC
cttggcataaaattttttag

SEQ ID NO: 14013 - DNA, 20 bp, Artificial Sequence
  Description of Artificial Sequence: Synthetic oligonucleotide
  Target: ANGPTL3; (+) strand; PAM type: YTN; PAM sequence: CTT
ggcataaaattttttagttt

SEQ ID NO: 14014 - DNA, 20 bp, Artificial Sequence
  Description of Artificial Sequence: Synthetic oligonucleotide
  Target: ANGPTL3; (+) strand; PAM type: YTN; PAM sequence: TTG
gcataaaattttttagtttt

SEQ ID NO: 14015 - DNA, 20 bp, Artificial Sequence
  Description of Artificial Sequence: Synthetic oligonucleotide
  Target: ANGPTL3; (+) strand; PAM type: YTN; PAM sequence: TTT
tttagtttttacattactgg

SEQ ID NO: 14016 - DNA, 20 bp, Artificial Sequence
  Description of Artificial Sequence: Synthetic oligonucleotide
  Target: ANGPTL3; (+) strand; PAM type: YTN; PAM sequence: TTT
ttagtttttacattactggt

SEQ ID NO: 14017 - DNA, 20 bp, Artificial Sequence
  Description of Artificial Sequence: Synthetic oligonucleotide
  Target: ANGPTL3; (+) strand; PAM type: YTN; PAM sequence: TTT
tagtttttacattactggtt

SEQ ID NO: 14018 - DNA, 20 bp, Artificial Sequence
  Description of Artificial Sequence: Synthetic oligonucleotide
  Target: ANGPTL3; (+) strand; PAM type: YTN; PAM sequence: TTT
agtttttacattactggtta

SEQ ID NO: 14019 - DNA, 20 bp, Artificial Sequence
  Description of Artificial Sequence: Synthetic oligonucleotide
  Target: ANGPTL3; (+) strand; PAM type: YTN; PAM sequence: TTA
gtttttacattactggttat

SEQ ID NO: 14020 - DNA, 20 bp, Artificial Sequence
  Description of Artificial Sequence: Synthetic oligonucleotide
  Target: ANGPTL3; (+) strand; PAM type: YTN; PAM sequence: TTT
ttacattactggttatattt

SEQ ID NO: 14021 - DNA, 20 bp, Artificial Sequence
  Description of Artificial Sequence: Synthetic oligonucleotide
  Target: ANGPTL3; (+) strand; PAM type: YTN; PAM sequence: TTT
tacattactggttatatttg

SEQ ID NO: 14022 - DNA, 20 bp, Artificial Sequence
  Description of Artificial Sequence: Synthetic oligonucleotide
  Target: ANGPTL3; (+) strand; PAM type: YTN; PAM sequence: TTT
acattactggttatatttga

SEQ ID NO: 14023 - DNA, 20 bp, Artificial Sequence
  Description of Artificial Sequence: Synthetic oligonucleotide
  Target: ANGPTL3; (+) strand; PAM type: YTN; PAM sequence: TTA
cattactggttatatttgat

SEQ ID NO: 14024 - DNA, 20 bp, Artificial Sequence
  Description of Artificial Sequence: Synthetic oligonucleotide
  Target: ANGPTL3; (+) strand; PAM type: YTN; PAM sequence: TTA
ctggttatatttgatcaggg

SEQ ID NO: 14025 - DNA, 20 bp, Artificial Sequence
  Description of Artificial Sequence: Synthetic oligonucleotide
  Target: ANGPTL3; (+) strand; PAM type: YTN; PAM sequence: CTG
gttatatttgatcagggttc

SEQ ID NO: 14026 - DNA, 20 bp, Artificial Sequence
  Description of Artificial Sequence: Synthetic oligonucleotide
  Target: ANGPTL3; (+) strand; PAM type: YTN; PAM sequence: TTA
tatttgatcagggttctatt

SEQ ID NO: 14027 - DNA, 20 bp, Artificial Sequence
  Description of Artificial Sequence: Synthetic oligonucleotide
  Target: ANGPTL3; (+) strand; PAM type: YTN; PAM sequence: TTT
gatcagggttctatttaaat

SEQ ID NO: 14028 - DNA, 20 bp, Artificial Sequence
  Description of Artificial Sequence: Synthetic oligonucleotide
  Target: ANGPTL3; (+) strand; PAM type: YTN; PAM sequence: TTG
atcagggttctatttaaata

SEQ ID NO: 14029 - DNA, 20 bp, Artificial Sequence
  Description of Artificial Sequence: Synthetic oligonucleotide
  Target: ANGPTL3; (+) strand; PAM type: YTN; PAM sequence: TTC
tatttaaataggcacaagtt

SEQ ID NO: 14030 - DNA, 20 bp, Artificial Sequence
  Description of Artificial Sequence: Synthetic oligonucleotide
  Target: ANGPTL3; (+) strand; PAM type: YTN; PAM sequence: CTA
tttaaataggcacaagttca

SEQ ID NO: 14031 - DNA, 20 bp, Artificial Sequence
  Description of Artificial Sequence: Synthetic oligonucleotide
  Target: ANGPTL3; (+) strand; PAM type: YTN; PAM sequence: TTT
aaataggcacaagttcaagc

SEQ ID NO: 14032 - DNA, 20 bp, Artificial Sequence
  Description of Artificial Sequence: Synthetic oligonucleotide
  Target: ANGPTL3; (+) strand; PAM type: YTN; PAM sequence: TTA
aataggcacaagttcaagca

SEQ ID NO: 14033 - DNA, 20 bp, Artificial Sequence
  Description of Artificial Sequence: Synthetic oligonucleotide
  Target: ANGPTL3; (+) strand; PAM type: YTN; PAM sequence: TTC
aagcaaagatcagattctgc

SEQ ID NO: 14034 - DNA, 20 bp, Artificial Sequence
  Description of Artificial Sequence: Synthetic oligonucleotide
  Target: ANGPTL3; (+) strand; PAM type: YTN; PAM sequence: TTC
tgcttttagcagtgtgtact

SEQ ID NO: 14035 - DNA, 20 bp, Artificial Sequence
  Description of Artificial Sequence: Synthetic oligonucleotide
  Target: ANGPTL3; (+) strand; PAM type: YTN; PAM sequence: CTG
cttttagcagtgtgtactca

SEQ ID NO: 14036 - DNA, 20 bp, Artificial Sequence
  Description of Artificial Sequence: Synthetic oligonucleotide
  Target: ANGPTL3; (+) strand; PAM type: YTN; PAM sequence: CTT
ttagcagtgtgtactcagac

SEQ ID NO: 14037 - DNA, 20 bp, Artificial Sequence
  Description of Artificial Sequence: Synthetic oligonucleotide
  Target: ANGPTL3; (+) strand; PAM type: YTN; PAM sequence: TTT
tagcagtgtgtactcagaca

SEQ ID NO: 14038 - DNA, 20 bp, Artificial Sequence
  Description of Artificial Sequence: Synthetic oligonucleotide
  Target: ANGPTL3; (+) strand; PAM type: YTN; PAM sequence: TTT
agcagtgtgtactcagacag

SEQ ID NO: 14039 - DNA, 20 bp, Artificial Sequence
  Description of Artificial Sequence: Synthetic oligonucleotide
  Target: ANGPTL3; (+) strand; PAM type: YTN; PAM sequence: TTA
gcagtgtgtactcagacagg

SEQ ID NO: 14040 - DNA, 20 bp, Artificial Sequence
  Description of Artificial Sequence: Synthetic oligonucleotide
  Target: ANGPTL3; (+) strand; PAM type: YTN; PAM sequence: CTC
agacaggaagtattaaaagg

SEQ ID NO: 14041 - DNA, 20 bp, Artificial Sequence
  Description of Artificial Sequence: Synthetic oligonucleotide
  Target: ANGPTL3; (+) strand; PAM type: YTN; PAM sequence: TTA
aaaggcaggcagaaaatcct

SEQ ID NO: 14042 - DNA, 20 bp, Artificial Sequence
  Description of Artificial Sequence: Synthetic oligonucleotide
  Target: ANGPTL3; (+) strand; PAM type: YTN; PAM sequence: CTT
tataaaattactactttcaa

SEQ ID NO: 14043 - DNA, 20 bp, Artificial Sequence
  Description of Artificial Sequence: Synthetic oligonucleotide
  Target: ANGPTL3; (+) strand; PAM type: YTN; PAM sequence: TTT
ataaaattactactttcaat

SEQ ID NO: 14044 - DNA, 20 bp, Artificial Sequence
  Description of Artificial Sequence: Synthetic oligonucleotide
  Target: ANGPTL3; (+) strand; PAM type: YTN; PAM sequence: TTA
taaaattactactttcaatg

SEQ ID NO: 14045 - DNA, 20 bp, Artificial Sequence
  Description of Artificial Sequence: Synthetic oligonucleotide
  Target: ANGPTL3; (+) strand; PAM type: YTN; PAM sequence: TTA
ctactttcaatgcattttcc

SEQ ID NO: 14046 - DNA, 20 bp, Artificial Sequence
  Description of Artificial Sequence: Synthetic oligonucleotide
  Target: ANGPTL3; (+) strand; PAM type: YTN; PAM sequence: CTA
ctttcaatgcattttcccac

SEQ ID NO: 14047 - DNA, 20 bp, Artificial Sequence
  Description of Artificial Sequence: Synthetic oligonucleotide
  Target: ANGPTL3; (+) strand; PAM type: YTN; PAM sequence: CTT
tcaatgcattttcccacgtt

SEQ ID NO: 14048 - DNA, 20 bp, Artificial Sequence
  Description of Artificial Sequence: Synthetic oligonucleotide
  Target: ANGPTL3; (+) strand; PAM type: YTN; PAM sequence: TTT
caatgcattttcccacgttg

SEQ ID NO: 14049 - DNA, 20 bp, Artificial Sequence
  Description of Artificial Sequence: Synthetic oligonucleotide
  Target: ANGPTL3; (+) strand; PAM type: YTN; PAM sequence: TTC
aatgcattttcccacgttga

SEQ ID NO: 14050 - DNA, 20 bp, Artificial Sequence
  Description of Artificial Sequence: Synthetic oligonucleotide
  Target: ANGPTL3; (+) strand; PAM type: YTN; PAM sequence: TTT
tcccacgttgaaatgcttct

SEQ ID NO: 14051 - DNA, 20 bp, Artificial Sequence
  Description of Artificial Sequence: Synthetic oligonucleotide
  Target: ANGPTL3; (+) strand; PAM type: YTN; PAM sequence: TTT
cccacgttgaaatgcttctg

SEQ ID NO: 14052 - DNA, 20 bp, Artificial Sequence
  Description of Artificial Sequence: Synthetic oligonucleotide
  Target: ANGPTL3; (+) strand; PAM type: YTN; PAM sequence: TTC
ccacgttgaaatgcttctgc

SEQ ID NO: 14053 - DNA, 20 bp, Artificial Sequence
  Description of Artificial Sequence: Synthetic oligonucleotide
  Target: ANGPTL3; (+) strand; PAM type: YTN; PAM sequence: TTG
aaatgcttctgcagtttata

SEQ ID NO: 14054 - DNA, 20 bp, Artificial Sequence
  Description of Artificial Sequence: Synthetic oligonucleotide
  Target: ANGPTL3; (+) strand; PAM type: YTN; PAM sequence: CTT
ctgcagtttataattaggca

SEQ ID NO: 14055 - DNA, 20 bp, Artificial Sequence
  Description of Artificial Sequence: Synthetic oligonucleotide
  Target: ANGPTL3; (+) strand; PAM type: YTN; PAM sequence: TTC
tgcagtttataattaggcaa

SEQ ID NO: 14056 - DNA, 20 bp, Artificial Sequence
  Description of Artificial Sequence: Synthetic oligonucleotide
  Target: ANGPTL3; (+) strand; PAM type: YTN; PAM sequence: CTG
cagtttataattaggcaaat

SEQ ID NO: 14057 - DNA, 20 bp, Artificial Sequence
  Description of Artificial Sequence: Synthetic oligonucleotide
  Target: ANGPTL3; (+) strand; PAM type: YTN; PAM sequence: TTT
ataattaggcaaattacttt

SEQ ID NO: 14058 - DNA, 20 bp, Artificial Sequence
  Description of Artificial Sequence: Synthetic oligonucleotide
  Target: ANGPTL3; (+) strand; PAM type: YTN; PAM sequence: TTA
taattaggcaaattacttta

SEQ ID NO: 14059 - DNA, 20 bp, Artificial Sequence
  Description of Artificial Sequence: Synthetic oligonucleotide
  Target: ANGPTL3; (+) strand; PAM type: YTN; PAM sequence: TTA
ggcaaattactttaattata

SEQ ID NO: 14060 - DNA, 20 bp, Artificial Sequence
  Description of Artificial Sequence: Synthetic oligonucleotide
  Target: ANGPTL3; (+) strand; PAM type: YTN; PAM sequence: TTA
ctttaattataatcaataat

SEQ ID NO: 14061 - DNA, 20 bp, Artificial Sequence
  Description of Artificial Sequence: Synthetic oligonucleotide
  Target: ANGPTL3; (+) strand; PAM type: YTN; PAM sequence: CTT
taattataatcaataatgct

SEQ ID NO: 14062 - DNA, 20 bp, Artificial Sequence
  Description of Artificial Sequence: Synthetic oligonucleotide
  Target: ANGPTL3; (+) strand; PAM type: YTN; PAM sequence: TTT
aattataatcaataatgctg

SEQ ID NO: 14063 - DNA, 20 bp, Artificial Sequence
  Description of Artificial Sequence: Synthetic oligonucleotide
  Target: ANGPTL3; (+) strand; PAM type: YTN; PAM sequence: TTA
attataatcaataatgctgt

SEQ ID NO: 14064 - DNA, 20 bp, Artificial Sequence
  Description of Artificial Sequence: Synthetic oligonucleotide
  Target: ANGPTL3; (+) strand; PAM type: YTN; PAM sequence: TTA
taatcaataatgctgttcaa

SEQ ID NO: 14065 - DNA, 20 bp, Artificial Sequence
  Description of Artificial Sequence: Synthetic oligonucleotide
  Target: ANGPTL3; (+) strand; PAM type: YTN; PAM sequence: CTG
ttcaaattactataagaatt

SEQ ID NO: 14066 - DNA, 20 bp, Artificial Sequence
  Description of Artificial Sequence: Synthetic oligonucleotide
  Target: ANGPTL3; (+) strand; PAM type: YTN; PAM sequence: TTC
aaattactataagaattata

SEQ ID NO: 14067 - DNA, 20 bp, Artificial Sequence
  Description of Artificial Sequence: Synthetic oligonucleotide
  Target: ANGPTL3; (+) strand; PAM type: YTN; PAM sequence: TTA
ctataagaattatacagata

SEQ ID NO: 14068 - DNA, 20 bp, Artificial Sequence
  Description of Artificial Sequence: Synthetic oligonucleotide
  Target: ANGPTL3; (+) strand; PAM type: YTN; PAM sequence: CTA
taagaattatacagatattt

SEQ ID NO: 14069 - DNA, 20 bp, Artificial Sequence
  Description of Artificial Sequence: Synthetic oligonucleotide
  Target: ANGPTL3; (+) strand; PAM type: YTN; PAM sequence: TTA
tacagatatttataccaaga

SEQ ID NO: 14070 - DNA, 20 bp, Artificial Sequence
  Description of Artificial Sequence: Synthetic oligonucleotide
  Target: ANGPTL3; (+) strand; PAM type: YTN; PAM sequence: TTT
ataccaagagacaatatact

SEQ ID NO: 14071 - DNA, 20 bp, Artificial Sequence
  Description of Artificial Sequence: Synthetic oligonucleotide
  Target: ANGPTL3; (+) strand; PAM type: YTN; PAM sequence: TTA
taccaagagacaatatacta

SEQ ID NO: 14072 - DNA, 20 bp, Artificial Sequence
  Description of Artificial Sequence: Synthetic oligonucleotide
  Target: ANGPTL3; (+) strand; PAM type: YTN; PAM sequence: CTA
gaaaccaagactacgtgacc

SEQ ID NO: 14073 - DNA, 20 bp, Artificial Sequence
  Description of Artificial Sequence: Synthetic oligonucleotide
  Target: ANGPTL3; (+) strand; PAM type: YTN; PAM sequence: CTA
cgtgaccattacctctactc

SEQ ID NO: 14074 - DNA, 20 bp, Artificial Sequence
  Description of Artificial Sequence: Synthetic oligonucleotide
  Target: ANGPTL3; (+) strand; PAM type: YTN; PAM sequence: TTA
cctctactctgtcagtgtta

SEQ ID NO: 14075 - DNA, 20 bp, Artificial Sequence
  Description of Artificial Sequence: Synthetic oligonucleotide
  Target: ANGPTL3; (+) strand; PAM type: YTN; PAM sequence: CTC
tactctgtcagtgttatttg

SEQ ID NO: 14076 - DNA, 20 bp, Artificial Sequence
  Description of Artificial Sequence: Synthetic oligonucleotide
  Target: ANGPTL3; (+) strand; PAM type: YTN; PAM sequence: CTA
ctctgtcagtgttatttgtg

SEQ ID NO: 14077 - DNA, 20 bp, Artificial Sequence
  Description of Artificial Sequence: Synthetic oligonucleotide
  Target: ANGPTL3; (+) strand; PAM type: YTN; PAM sequence: CTC
tgtcagtgttatttgtgaga

SEQ ID NO: 14078 - DNA, 20 bp, Artificial Sequence
  Description of Artificial Sequence: Synthetic oligonucleotide
  Target: ANGPTL3; (+) strand; PAM type: YTN; PAM sequence: CTG
tcagtgttatttgtgagaaa

SEQ ID NO: 14079 - DNA, 20 bp, Artificial Sequence
  Description of Artificial Sequence: Synthetic oligonucleotide
  Target: ANGPTL3; (+) strand; PAM type: YTN; PAM sequence: TTA
tttgtgagaaattgcacaaa

SEQ ID NO: 14080 - DNA, 20 bp, Artificial Sequence
  Description of Artificial Sequence: Synthetic oligonucleotide
  Target: ANGPTL3; (+) strand; PAM type: YTN; PAM sequence: TTT
gtgagaaattgcacaaattt

SEQ ID NO: 14081 - DNA, 20 bp, Artificial Sequence
  Description of Artificial Sequence: Synthetic oligonucleotide
  Target: ANGPTL3; (+) strand; PAM type: YTN; PAM sequence: TTG
tgagaaattgcacaaatttt

SEQ ID NO: 14082 - DNA, 20 bp, Artificial Sequence
  Description of Artificial Sequence: Synthetic oligonucleotide
  Target: ANGPTL3; (+) strand; PAM type: YTN; PAM sequence: TTG
cacaaattttgcaaaaagtg

SEQ ID NO: 14083 - DNA, 20 bp, Artificial Sequence
  Description of Artificial Sequence: Synthetic oligonucleotide
  Target: ANGPTL3; (+) strand; PAM type: YTN; PAM sequence: TTT
tgcaaaaagtgttagtatcc

SEQ ID NO: 14084 - DNA, 20 bp, Artificial Sequence
  Description of Artificial Sequence: Synthetic oligonucleotide
  Target: ANGPTL3; (+) strand; PAM type: YTN; PAM sequence: TTT
gcaaaaagtgttagtatcct

SEQ ID NO: 14085 - DNA, 20 bp, Artificial Sequence
  Description of Artificial Sequence: Synthetic oligonucleotide
  Target: ANGPTL3; (+) strand; PAM type: YTN; PAM sequence: TTG
caaaaagtgttagtatccta

SEQ ID NO: 14086 - DNA, 20 bp, Artificial Sequence
  Description of Artificial Sequence: Synthetic oligonucleotide
  Target: ANGPTL3; (+) strand; PAM type: YTN; PAM sequence: TTA
gtatcctactacagtaggat

SEQ ID NO: 14087 - DNA, 20 bp, Artificial Sequence
  Description of Artificial Sequence: Synthetic oligonucleotide
  Target: ANGPTL3; (+) strand; PAM type: YTN; PAM sequence: CTA
ctacagtaggatataatata

SEQ ID NO: 14088 - DNA, 20 bp, Artificial Sequence
  Description of Artificial Sequence: Synthetic oligonucleotide
  Target: ANGPTL3; (+) strand; PAM type: YTN; PAM sequence: CTA
cagtaggatataatatagaa

SEQ ID NO: 14089 - DNA, 20 bp, Artificial Sequence
  Description of Artificial Sequence: Synthetic oligonucleotide
  Target: ANGPTL3; (+) strand; PAM type: YTN; PAM sequence: TTT
cataaagcctgtctttggta

SEQ ID NO: 14090 - DNA, 20 bp, Artificial Sequence
  Description of Artificial Sequence: Synthetic oligonucleotide
  Target: ANGPTL3; (+) strand; PAM type: YTN; PAM sequence: TTC
ataaagcctgtctttggtac

SEQ ID NO: 14091 - DNA, 20 bp, Artificial Sequence
  Description of Artificial Sequence: Synthetic oligonucleotide
  Target: ANGPTL3; (+) strand; PAM type: YTN; PAM sequence: CTG
tctttggtactagtgctcag

SEQ ID NO: 14092 - DNA, 20 bp, Artificial Sequence
  Description of Artificial Sequence: Synthetic oligonucleotide
  Target: ANGPTL3; (+) strand; PAM type: YTN; PAM sequence: CTT
tggtactagtgctcagttac

SEQ ID NO: 14093 - DNA, 20 bp, Artificial Sequence
  Description of Artificial Sequence: Synthetic oligonucleotide
  Target: ANGPTL3; (+) strand; PAM type: YTN; PAM sequence: TTT
ggtactagtgctcagttact

SEQ ID NO: 14094 - DNA, 20 bp, Artificial Sequence
  Description of Artificial Sequence: Synthetic oligonucleotide
  Target: ANGPTL3; (+) strand; PAM type: YTN; PAM sequence: TTG
gtactagtgctcagttactt

SEQ ID NO: 14095 - DNA, 20 bp, Artificial Sequence
  Description of Artificial Sequence: Synthetic oligonucleotide
  Target: ANGPTL3; (+) strand; PAM type: YTN; PAM sequence: CTA
gtgctcagttactttcatta

SEQ ID NO: 14096 - DNA, 20 bp, Artificial Sequence
  Description of Artificial Sequence: Synthetic oligonucleotide
  Target: ANGPTL3; (+) strand; PAM type: YTN; PAM sequence: CTC
agttactttcattaactaaa

SEQ ID NO: 14097 - DNA, 20 bp, Artificial Sequence
  Description of Artificial Sequence: Synthetic oligonucleotide
  Target: ANGPTL3; (+) strand; PAM type: YTN; PAM sequence: TTA
ctttcattaactaaaaaagg

SEQ ID NO: 14098 - DNA, 20 bp, Artificial Sequence
  Description of Artificial Sequence: Synthetic oligonucleotide
  Target: ANGPTL3; (+) strand; PAM type: YTN; PAM sequence: CTT
tcattaactaaaaaaggggc

SEQ ID NO: 14099 - DNA, 20 bp, Artificial Sequence
  Description of Artificial Sequence: Synthetic oligonucleotide
  Target: ANGPTL3; (+) strand; PAM type: YTN; PAM sequence: TTT
cattaactaaaaaaggggct

SEQ ID NO: 14100 - DNA, 20 bp, Artificial Sequence
  Description of Artificial Sequence: Synthetic oligonucleotide
  Target: ANGPTL3; (+) strand; PAM type: YTN; PAM sequence: TTC
attaactaaaaaaggggcta

SEQ ID NO: 14101 - DNA, 20 bp, Artificial Sequence
  Description of Artificial Sequence: Synthetic oligonucleotide
  Target: ANGPTL3; (+) strand; PAM type: YTN; PAM sequence: TTA
actaaaaaaggggctactct

SEQ ID NO: 14102 - DNA, 20 bp, Artificial Sequence
  Description of Artificial Sequence: Synthetic oligonucleotide
  Target: ANGPTL3; (+) strand; PAM type: YTN; PAM sequence: CTA
aaaaaggggctactcttcaa

SEQ ID NO: 14103 - DNA, 20 bp, Artificial Sequence
  Description of Artificial Sequence: Synthetic oligonucleotide
  Target: ANGPTL3; (+) strand; PAM type: YTN; PAM sequence: CTA
ctcttcaaattcccttctct

SEQ ID NO: 14104 - DNA, 20 bp, Artificial Sequence
  Description of Artificial Sequence: Synthetic oligonucleotide
  Target: ANGPTL3; (+) strand; PAM type: YTN; PAM sequence: CTC
ttcaaattcccttctctaaa

SEQ ID NO: 14105 - DNA, 20 bp, Artificial Sequence
  Description of Artificial Sequence: Synthetic oligonucleotide
  Target: ANGPTL3; (+) strand; PAM type: YTN; PAM sequence: CTT
caaattcccttctctaaaaa

SEQ ID NO: 14106 - DNA, 20 bp, Artificial Sequence
  Description of Artificial Sequence: Synthetic oligonucleotide
  Target: ANGPTL3; (+) strand; PAM type: YTN; PAM sequence: TTC
aaattcccttctctaaaaag

SEQ ID NO: 14107 - DNA, 20 bp, Artificial Sequence
  Description of Artificial Sequence: Synthetic oligonucleotide
  Target: ANGPTL3; (+) strand; PAM type: YTN; PAM sequence: TTC
ccttctctaaaaagaatgta

SEQ ID NO: 14108 - DNA, 20 bp, Artificial Sequence
  Description of Artificial Sequence: Synthetic oligonucleotide
  Target: ANGPTL3; (+) strand; PAM type: YTN; PAM sequence: CTT
ctctaaaaagaatgtactat

SEQ ID NO: 14109 - DNA, 20 bp, Artificial Sequence
  Description of Artificial Sequence: Synthetic oligonucleotide
  Target: ANGPTL3; (+) strand; PAM type: YTN; PAM sequence: TTC
tctaaaaagaatgtactata

SEQ ID NO: 14110 - DNA, 20 bp, Artificial Sequence
  Description of Artificial Sequence: Synthetic oligonucleotide
  Target: ANGPTL3; (+) strand; PAM type: YTN; PAM sequence: CTC
taaaaagaatgtactatatc

SEQ ID NO: 14111 - DNA, 20 bp, Artificial Sequence
  Description of Artificial Sequence: Synthetic oligonucleotide
  Target: ANGPTL3; (+) strand; PAM type: YTN; PAM sequence: CTA
aaaagaatgtactatatcaa

SEQ ID NO: 14112 - DNA, 20 bp, Artificial Sequence
  Description of Artificial Sequence: Synthetic oligonucleotide
  Target: ANGPTL3; (+) strand; PAM type: YTN; PAM sequence: CTA
tatcaaaagggggtaaacac

SEQ ID NO: 14113 - DNA, 20 bp, Artificial Sequence
  Description of Artificial Sequence: Synthetic oligonucleotide
  Target: ANGPTL3; (+) strand; PAM type: YTN; PAM sequence: CTA
ctacgtatacattctgcact

SEQ ID NO: 14114 - DNA, 20 bp, Artificial Sequence
  Description of Artificial Sequence: Synthetic oligonucleotide
  Target: ANGPTL3; (+) strand; PAM type: YTN; PAM sequence: CTA
cgtatacattctgcacttag

SEQ ID NO: 14115 - DNA, 20 bp, Artificial Sequence
  Description of Artificial Sequence: Synthetic oligonucleotide
  Target: ANGPTL3; (+) strand; PAM type: YTN; PAM sequence: TTC
tgcacttagaaatccctata

SEQ ID NO: 14116 - DNA, 20 bp, Artificial Sequence
  Description of Artificial Sequence: Synthetic oligonucleotide
  Target: ANGPTL3; (+) strand; PAM type: YTN; PAM sequence: CTG
cacttagaaatccctatatg

SEQ ID NO: 14117 - DNA, 20 bp, Artificial Sequence
  Description of Artificial Sequence: Synthetic oligonucleotide
  Target: ANGPTL3; (+) strand; PAM type: YTN; PAM sequence: CTT
agaaatccctatatgttgat

SEQ ID NO: 14118 - DNA, 20 bp, Artificial Sequence
  Description of Artificial Sequence: Synthetic oligonucleotide
  Target: ANGPTL3; (+) strand; PAM type: YTN; PAM sequence: TTA
gaaatccctatatgttgatt

SEQ ID NO: 14119 - DNA, 20 bp, Artificial Sequence
  Description of Artificial Sequence: Synthetic oligonucleotide
  Target: ANGPTL3; (+) strand; PAM type: YTN; PAM sequence: CTA
tatgttgattttatcattct

SEQ ID NO: 14120 - DNA, 20 bp, Artificial Sequence
  Description of Artificial Sequence: Synthetic oligonucleotide
  Target: ANGPTL3; (+) strand; PAM type: YTN; PAM sequence: TTG
attttatcattctcttattc

SEQ ID NO: 14121 - DNA, 20 bp, Artificial Sequence
  Description of Artificial Sequence: Synthetic oligonucleotide
  Target: ANGPTL3; (+) strand; PAM type: YTN; PAM sequence: TTT
tatcattctcttattcaata

SEQ ID NO: 14122 - DNA, 20 bp, Artificial Sequence
  Description of Artificial Sequence: Synthetic oligonucleotide
  Target: ANGPTL3; (+) strand; PAM type: YTN; PAM sequence: TTT
atcattctcttattcaataa

SEQ ID NO: 14123 - DNA, 20 bp, Artificial Sequence
  Description of Artificial Sequence: Synthetic oligonucleotide
  Target: ANGPTL3; (+) strand; PAM type: YTN; PAM sequence: TTA
tcattctcttattcaataaa

SEQ ID NO: 14124 - DNA, 20 bp, Artificial Sequence
  Description of Artificial Sequence: Synthetic oligonucleotide
  Target: ANGPTL3; (+) strand; PAM type: YTN; PAM sequence: TTC
tcttattcaataaatattgt

SEQ ID NO: 14125 - DNA, 20 bp, Artificial Sequence
  Description of Artificial Sequence: Synthetic oligonucleotide
  Target: ANGPTL3; (+) strand; PAM type: YTN; PAM sequence: CTC
ttattcaataaatattgttt

SEQ ID NO: 14126 - DNA, 20 bp, Artificial Sequence
  Description of Artificial Sequence: Synthetic oligonucleotide
  Target: ANGPTL3; (+) strand; PAM type: YTN; PAM sequence: CTT
attcaataaatattgtttct

SEQ ID NO: 14127 - DNA, 20 bp, Artificial Sequence
  Description of Artificial Sequence: Synthetic oligonucleotide
  Target: ANGPTL3; (+) strand; PAM type: YTN; PAM sequence: TTA
ttcaataaatattgtttcta

SEQ ID NO: 14128 - DNA, 20 bp, Artificial Sequence
  Description of Artificial Sequence: Synthetic oligonucleotide
  Target: ANGPTL3; (+) strand; PAM type: YTN; PAM sequence: TTC
aataaatattgtttctacaa

SEQ ID NO: 14129 - DNA, 20 bp, Artificial Sequence
  Description of Artificial Sequence: Synthetic oligonucleotide
  Target: ANGPTL3; (+) strand; PAM type: YTN; PAM sequence: TTG
tttctacaatgtgtaaggca

SEQ ID NO: 14130 - DNA, 20 bp, Artificial Sequence
  Description of Artificial Sequence: Synthetic oligonucleotide
  Target: ANGPTL3; (+) strand; PAM type: YTN; PAM sequence: TTT
ctacaatgtgtaaggcatta

SEQ ID NO: 14131 - DNA, 20 bp, Artificial Sequence
  Description of Artificial Sequence: Synthetic oligonucleotide
  Target: ANGPTL3; (+) strand; PAM type: YTN; PAM sequence: TTC
tacaatgtgtaaggcattac

SEQ ID NO: 14132 - DNA, 20 bp, Artificial Sequence
  Description of Artificial Sequence: Synthetic oligonucleotide
  Target: ANGPTL3; (+) strand; PAM type: YTN; PAM sequence: CTA
caatgtgtaaggcattactg

SEQ ID NO: 14133 - DNA, 20 bp, Artificial Sequence
  Description of Artificial Sequence: Synthetic oligonucleotide
  Target: ANGPTL3; (+) strand; PAM type: YTN; PAM sequence: TTA
ctgtactaaagcattataag

SEQ ID NO: 14134 - DNA, 20 bp, Artificial Sequence
  Description of Artificial Sequence: Synthetic oligonucleotide
  Target: ANGPTL3; (+) strand; PAM type: YTN; PAM sequence: CTG
tactaaagcattataaggaa

SEQ ID NO: 14135 - DNA, 20 bp, Artificial Sequence
  Description of Artificial Sequence: Synthetic oligonucleotide
  Target: ANGPTL3; (+) strand; PAM type: YTN; PAM sequence: CTA
aagcattataaggaatataa

SEQ ID NO: 14136 - DNA, 20 bp, Artificial Sequence
  Description of Artificial Sequence: Synthetic oligonucleotide
  Target: ANGPTL3; (+) strand; PAM type: YTN; PAM sequence: TTA
taaggaatataagttaaaaa

SEQ ID NO: 14137 - DNA, 20 bp, Artificial Sequence
  Description of Artificial Sequence: Synthetic oligonucleotide
  Target: ANGPTL3; (+) strand; PAM type: YTN; PAM sequence: TTA
aaaacacatacaaatcttgc

SEQ ID NO: 14138 - DNA, 20 bp, Artificial Sequence
  Description of Artificial Sequence: Synthetic oligonucleotide
  Target: ANGPTL3; (+) strand; PAM type: YTN; PAM sequence: CTT
gccaatcaacagcttatagt

SEQ ID NO: 14139 - DNA, 20 bp, Artificial Sequence
  Description of Artificial Sequence: Synthetic oligonucleotide
  Target: ANGPTL3; (+) strand; PAM type: YTN; PAM sequence: TTG
ccaatcaacagcttatagtg

SEQ ID NO: 14140 - DNA, 20 bp, Artificial Sequence
  Description of Artificial Sequence: Synthetic oligonucleotide
  Target: ANGPTL3; (+) strand; PAM type: YTN; PAM sequence: CTT
atagtgtaataggggagaga

SEQ ID NO: 14141 - DNA, 20 bp, Artificial Sequence
  Description of Artificial Sequence: Synthetic oligonucleotide
  Target: ANGPTL3; (+) strand; PAM type: YTN; PAM sequence: TTA
tagtgtaataggggagagaa

SEQ ID NO: 14142 - DNA, 20 bp, Artificial Sequence
  Description of Artificial Sequence: Synthetic oligonucleotide
  Target: ANGPTL3; (+) strand; PAM type: YTN; PAM sequence: CTG
gcccatctatattctccctc

SEQ ID NO: 14143 - DNA, 20 bp, Artificial Sequence
  Description of Artificial Sequence: Synthetic oligonucleotide
  Target: ANGPTL3; (+) strand; PAM type: YTN; PAM sequence: CTA
tattctccctcaactagcaa

SEQ ID NO: 14144 - DNA, 20 bp, Artificial Sequence
  Description of Artificial Sequence: Synthetic oligonucleotide
  Target: ANGPTL3; (+) strand; PAM type: YTN; PAM sequence: TTC
tccctcaactagcaagtgga

SEQ ID NO: 14145 - DNA, 20 bp, Artificial Sequence
  Description of Artificial Sequence: Synthetic oligonucleotide
  Target: ANGPTL3; (+) strand; PAM type: YTN; PAM sequence: CTC
cctcaactagcaagtggatg

SEQ ID NO: 14146 - DNA, 20 bp, Artificial Sequence
  Description of Artificial Sequence: Synthetic oligonucleotide
  Target: ANGPTL3; (+) strand; PAM type: YTN; PAM sequence: CTC
aactagcaagtggatgaaat

SEQ ID NO: 14147 - DNA, 20 bp, Artificial Sequence
  Description of Artificial Sequence: Synthetic oligonucleotide
  Target: ANGPTL3; (+) strand; PAM type: YTN; PAM sequence: CTA
gcaagtggatgaaatatcag

SEQ ID NO: 14148 - DNA, 20 bp, Artificial Sequence
  Description of Artificial Sequence: Synthetic oligonucleotide
  Target: ANGPTL3; (+) strand; PAM type: YTN; PAM sequence: TTA
taagccacaaaagctgacag

SEQ ID NO: 14149 - DNA, 20 bp, Artificial Sequence
  Description of Artificial Sequence: Synthetic oligonucleotide
  Target: ANGPTL3; (+) strand; PAM type: YTN; PAM sequence: CTG
acagcttaattaagagaagt

SEQ ID NO: 14150 - DNA, 20 bp, Artificial Sequence
  Description of Artificial Sequence: Synthetic oligonucleotide
  Target: ANGPTL3; (+) strand; PAM type: YTN; PAM sequence: CTT
aattaagagaagttttgaaa

SEQ ID NO: 14151 - DNA, 20 bp, Artificial Sequence
  Description of Artificial Sequence: Synthetic oligonucleotide
  Target: ANGPTL3; (+) strand; PAM type: YTN; PAM sequence: TTA
attaagagaagttttgaaat

SEQ ID NO: 14152 - DNA, 20 bp, Artificial Sequence
  Description of Artificial Sequence: Synthetic oligonucleotide
  Target: ANGPTL3; (+) strand; PAM type: YTN; PAM sequence: TTA
agagaagttttgaaatatgt

SEQ ID NO: 14153 - DNA, 20 bp, Artificial Sequence
  Description of Artificial Sequence: Synthetic oligonucleotide
  Target: ANGPTL3; (+) strand; PAM type: YTN; PAM sequence: TTT
tgaaatatgtatttcatgac

SEQ ID NO: 14154 - DNA, 20 bp, Artificial Sequence
  Description of Artificial Sequence: Synthetic oligonucleotide
  Target: ANGPTL3; (+) strand; PAM type: YTN; PAM sequence: TTT
gaaatatgtatttcatgacc

SEQ ID NO: 14155 - DNA, 20 bp, Artificial Sequence
  Description of Artificial Sequence: Synthetic oligonucleotide
  Target: ANGPTL3; (+) strand; PAM type: YTN; PAM sequence: TTG
aaatatgtatttcatgacca

SEQ ID NO: 14156 - DNA, 20 bp, Artificial Sequence
  Description of Artificial Sequence: Synthetic oligonucleotide
  Target: ANGPTL3; (+) strand; PAM type: YTN; PAM sequence: TTT
catgaccaataattacaact

SEQ ID NO: 14157 - DNA, 20 bp, Artificial Sequence
  Description of Artificial Sequence: Synthetic oligonucleotide
  Target: ANGPTL3; (+) strand; PAM type: YTN; PAM sequence: TTC
atgaccaataattacaactg

SEQ ID NO: 14158 - DNA, 20 bp, Artificial Sequence
  Description of Artificial Sequence: Synthetic oligonucleotide
  Target: ANGPTL3; (+) strand; PAM type: YTN; PAM sequence: TTA
caactgtaacttttctattt

SEQ ID NO: 14159 - DNA, 20 bp, Artificial Sequence
  Description of Artificial Sequence: Synthetic oligonucleotide
  Target: ANGPTL3; (+) strand; PAM type: YTN; PAM sequence: CTG
taacttttctatttaaagaa

SEQ ID NO: 14160 - DNA, 20 bp, Artificial Sequence
  Description of Artificial Sequence: Synthetic oligonucleotide
  Target: ANGPTL3; (+) strand; PAM type: YTN; PAM sequence: CTT
ttctatttaaagaaggagaa

SEQ ID NO: 14161 - DNA, 20 bp, Artificial Sequence
  Description of Artificial Sequence: Synthetic oligonucleotide
  Target: ANGPTL3; (+) strand; PAM type: YTN; PAM sequence: TTT
tctatttaaagaaggagaaa

SEQ ID NO: 14162 - DNA, 20 bp, Artificial Sequence
  Description of Artificial Sequence: Synthetic oligonucleotide
  Target: ANGPTL3; (+) strand; PAM type: YTN; PAM sequence: TTT
ctatttaaagaaggagaaaa

SEQ ID NO: 14163 - DNA, 20 bp, Artificial Sequence
  Description of Artificial Sequence: Synthetic oligonucleotide
  Target: ANGPTL3; (+) strand; PAM type: YTN; PAM sequence: TTC
tatttaaagaaggagaaaat

SEQ ID NO: 14164 - DNA, 20 bp, Artificial Sequence
  Description of Artificial Sequence: Synthetic oligonucleotide
  Target: ANGPTL3; (+) strand; PAM type: YTN; PAM sequence: CTA
tttaaagaaggagaaaattt

SEQ ID NO: 14165 - DNA, 20 bp, Artificial Sequence
  Description of Artificial Sequence: Synthetic oligonucleotide
  Target: ANGPTL3; (+) strand; PAM type: YTN; PAM sequence: TTT
aaagaaggagaaaatttgaa

SEQ ID NO: 14166 - DNA, 20 bp, Artificial Sequence
  Description of Artificial Sequence: Synthetic oligonucleotide
  Target: ANGPTL3; (+) strand; PAM type: YTN; PAM sequence: TTA
aagaaggagaaaatttgaat

SEQ ID NO: 14167 - DNA, 20 bp, Artificial Sequence
  Description of Artificial Sequence: Synthetic oligonucleotide
  Target: ANGPTL3; (+) strand; PAM type: YTN; PAM sequence: TTT
gaatttcttctctagctcaa

SEQ ID NO: 14168 - DNA, 20 bp, Artificial Sequence
  Description of Artificial Sequence: Synthetic oligonucleotide
  Target: ANGPTL3; (+) strand; PAM type: YTN; PAM sequence: TTG
aatttcttctctagctcaac

SEQ ID NO: 14169 - DNA, 20 bp, Artificial Sequence
  Description of Artificial Sequence: Synthetic oligonucleotide
  Target: ANGPTL3; (+) strand; PAM type: YTN; PAM sequence: TTT
cttctctagctcaacataca

SEQ ID NO: 14170 - DNA, 20 bp, Artificial Sequence
  Description of Artificial Sequence: Synthetic oligonucleotide
  Target: ANGPTL3; (+) strand; PAM type: YTN; PAM sequence: TTC
ttctctagctcaacatacac

SEQ ID NO: 14171 - DNA, 20 bp, Artificial Sequence
  Description of Artificial Sequence: Synthetic oligonucleotide
  Target: ANGPTL3; (+) strand; PAM type: YTN; PAM sequence: CTT
ctctagctcaacatacactt

SEQ ID NO: 14172 - DNA, 20 bp, Artificial Sequence
  Description of Artificial Sequence: Synthetic oligonucleotide
  Target: ANGPTL3; (+) strand; PAM type: YTN; PAM sequence: TTC
tctagctcaacatacacttc

SEQ ID NO: 14173 - DNA, 20 bp, Artificial Sequence
  Description of Artificial Sequence: Synthetic oligonucleotide
  Target: ANGPTL3; (+) strand; PAM type: YTN; PAM sequence: CTC
tagctcaacatacacttcta

SEQ ID NO: 14174 - DNA, 20 bp, Artificial Sequence
  Description of Artificial Sequence: Synthetic oligonucleotide
  Target: ANGPTL3; (+) strand; PAM type: YTN; PAM sequence: CTA
gctcaacatacacttctata

SEQ ID NO: 14175 - DNA, 20 bp, Artificial Sequence
  Description of Artificial Sequence: Synthetic oligonucleotide
  Target: ANGPTL3; (+) strand; PAM type: YTN; PAM sequence: CTC
aacatacacttctataattc

SEQ ID NO: 14176 - DNA, 20 bp, Artificial Sequence
  Description of Artificial Sequence: Synthetic oligonucleotide
  Target: ANGPTL3; (+) strand; PAM type: YTN; PAM sequence: CTT
ctataattccattacatgaa

SEQ ID NO: 14177 - DNA, 20 bp, Artificial Sequence
  Description of Artificial Sequence: Synthetic oligonucleotide
  Target: ANGPTL3; (+) strand; PAM type: YTN; PAM sequence: TTC
tataattccattacatgaac

SEQ ID NO: 14178 - DNA, 20 bp, Artificial Sequence
  Description of Artificial Sequence: Synthetic oligonucleotide
  Target: ANGPTL3; (+) strand; PAM type: YTN; PAM sequence: CTA
taattccattacatgaacca

SEQ ID NO: 14179 - DNA, 20 bp, Artificial Sequence
  Description of Artificial Sequence: Synthetic oligonucleotide
  Target: ANGPTL3; (+) strand; PAM type: YTN; PAM sequence: TTC
cattacatgaaccagagtaa

SEQ ID NO: 14180 - DNA, 20 bp, Artificial Sequence
  Description of Artificial Sequence: Synthetic oligonucleotide
  Target: ANGPTL3; (+) strand; PAM type: YTN; PAM sequence: TTA
catgaaccagagtaaagggt

SEQ ID NO: 14181 - DNA, 20 bp, Artificial Sequence
  Description of Artificial Sequence: Synthetic oligonucleotide
  Target: ANGPTL3; (+) strand; PAM type: YTN; PAM sequence: TTT
tcttacccttttgtggttct

SEQ ID NO: 14182 - DNA, 20 bp, Artificial Sequence
  Description of Artificial Sequence: Synthetic oligonucleotide
  Target: ANGPTL3; (+) strand; PAM type: YTN; PAM sequence: TTT
cttacccttttgtggttcta

SEQ ID NO: 14183 - DNA, 20 bp, Artificial Sequence
  Description of Artificial Sequence: Synthetic oligonucleotide
  Target: ANGPTL3; (+) strand; PAM type: YTN; PAM sequence: TTC
ttacccttttgtggttctat

SEQ ID NO: 14184 - DNA, 20 bp, Artificial Sequence
  Description of Artificial Sequence: Synthetic oligonucleotide
  Target: ANGPTL3; (+) strand; PAM type: YTN; PAM sequence: CTT
acccttttgtggttctatat

SEQ ID NO: 14185 - DNA, 20 bp, Artificial Sequence
  Description of Artificial Sequence: Synthetic oligonucleotide
  Target: ANGPTL3; (+) strand; PAM type: YTN; PAM sequence: TTA
cccttttgtggttctatatt

SEQ ID NO: 14186 - DNA, 20 bp, Artificial Sequence
  Description of Artificial Sequence: Synthetic oligonucleotide
  Target: ANGPTL3; (+) strand; PAM type: YTN; PAM sequence: CTT
ttgtggttctatattggaca

SEQ ID NO: 14187 - DNA, 20 bp, Artificial Sequence
  Description of Artificial Sequence: Synthetic oligonucleotide
  Target: ANGPTL3; (+) strand; PAM type: YTN; PAM sequence: TTT
tgtggttctatattggacac

SEQ ID NO: 14188 - DNA, 20 bp, Artificial Sequence
  Description of Artificial Sequence: Synthetic oligonucleotide
  Target: ANGPTL3; (+) strand; PAM type: YTN; PAM sequence: TTT
gtggttctatattggacact

SEQ ID NO: 14189 - DNA, 20 bp, Artificial Sequence
  Description of Artificial Sequence: Synthetic oligonucleotide
  Target: ANGPTL3; (+) strand; PAM type: YTN; PAM sequence: TTG
tggttctatattggacactt

SEQ ID NO: 14190 - DNA, 20 bp, Artificial Sequence
  Description of Artificial Sequence: Synthetic oligonucleotide
  Target: ANGPTL3; (+) strand; PAM type: YTN; PAM sequence: TTC
tatattggacacttaaaaat

SEQ ID NO: 14191 - DNA, 20 bp, Artificial Sequence
  Description of Artificial Sequence: Synthetic oligonucleotide
  Target: ANGPTL3; (+) strand; PAM type: YTN; PAM sequence: CTA
tattggacacttaaaaatca

SEQ ID NO: 14192 - DNA, 20 bp, Artificial Sequence
  Description of Artificial Sequence: Synthetic oligonucleotide
  Target: ANGPTL3; (+) strand; PAM type: YTN; PAM sequence: TTG
gacacttaaaaatcatacac

SEQ ID NO: 14193 - DNA, 20 bp, Artificial Sequence
  Description of Artificial Sequence: Synthetic oligonucleotide
  Target: ANGPTL3; (+) strand; PAM type: YTN; PAM sequence: CTT
aaaaatcatacacaacctaa

SEQ ID NO: 14194 - DNA, 20 bp, Artificial Sequence
  Description of Artificial Sequence: Synthetic oligonucleotide
  Target: ANGPTL3; (+) strand; PAM type: YTN; PAM sequence: TTA
aaaatcatacacaacctaat

SEQ ID NO: 14195 - DNA, 20 bp, Artificial Sequence
  Description of Artificial Sequence: Synthetic oligonucleotide
  Target: ANGPTL3; (+) strand; PAM type: YTN; PAM sequence: CTA
atcaaaagatgtaattcttt

SEQ ID NO: 14196 - DNA, 20 bp, Artificial Sequence
  Description of Artificial Sequence: Synthetic oligonucleotide
  Target: ANGPTL3; (+) strand; PAM type: YTN; PAM sequence: TTC
tttaaaaaggtacgagacca

SEQ ID NO: 14197 - DNA, 20 bp, Artificial Sequence
  Description of Artificial Sequence: Synthetic oligonucleotide
  Target: ANGPTL3; (+) strand; PAM type: YTN; PAM sequence: CTT
taaaaaggtacgagaccaaa

SEQ ID NO: 14198 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaggtacgagaccaaaa

SEQ ID NO: 14199 - DNA, 20 bp, Artificial Sequence
  Description of Artificial Sequence: Synthetic oligonucleotide
  Target: ANGPTL3; (+) strand; PAM type: YTN; PAM sequence: TTA
aaaaggtacgagaccaaaat

SEQ ID NO: 14200 - DNA, 20 bp, Artificial Sequence
  Description of Artificial Sequence: Synthetic oligonucleotide
  Target: ANGPTL3; (+) strand; PAM type: YTN; PAM sequence: TTC
agaaaatctagactataaca

SEQ ID NO: 14201 - DNA, 20 bp, Artificial Sequence
  Description of Artificial Sequence: Synthetic oligonucleotide
  Target: ANGPTL3; (+) strand; PAM type: YTN; PAM sequence: CTA
gactataacaaaatttctca

SEQ ID NO: 14202 - DNA, 20 bp, Artificial Sequence
  Description of Artificial Sequence: Synthetic oligonucleotide
  Target: ANGPTL3; (+) strand; PAM type: YTN; PAM sequence: CTA
taacaaaatttctcaattta

SEQ ID NO: 14203 - DNA, 20 bp, Artificial Sequence
  Description of Artificial Sequence: Synthetic oligonucleotide
  Target: ANGPTL3; (+) strand; PAM type: YTN; PAM sequence: TTT
ctcaatttacattatcttaa

SEQ ID NO: 14204 - DNA, 20 bp, Artificial Sequence
  Description of Artificial Sequence: Synthetic oligonucleotide
  Target: ANGPTL3; (+) strand; PAM type: YTN; PAM sequence: TTC
tcaatttacattatcttaat

SEQ ID NO: 14205 - DNA, 20 bp, Artificial Sequence
  Description of Artificial Sequence: Synthetic oligonucleotide
  Target: ANGPTL3; (+) strand; PAM type: YTN; PAM sequence: CTC
aatttacattatcttaatat

SEQ ID NO: 14206 - DNA, 20 bp, Artificial Sequence
  Description of Artificial Sequence: Synthetic oligonucleotide
  Target: ANGPTL3; (+) strand; PAM type: YTN; PAM sequence: TTT
acattatcttaatatgcaat

SEQ ID NO: 14207 - DNA, 20 bp, Artificial Sequence
  Description of Artificial Sequence: Synthetic oligonucleotide
  Target: ANGPTL3; (+) strand; PAM type: YTN; PAM sequence: TTA
cattatcttaatatgcaatt

SEQ ID NO: 14208 - DNA, 20 bp, Artificial Sequence
  Description of Artificial Sequence: Synthetic oligonucleotide
  Target: ANGPTL3; (+) strand; PAM type: YTN; PAM sequence: TTA
tcttaatatgcaattaattt

SEQ ID NO: 14209 - DNA, 20 bp, Artificial Sequence
  Description of Artificial Sequence: Synthetic oligonucleotide
  Target: ANGPTL3; (+) strand; PAM type: YTN; PAM sequence: CTT
aatatgcaattaattttcac

SEQ ID NO: 14210 - DNA, 20 bp, Artificial Sequence
  Description of Artificial Sequence: Synthetic oligonucleotide
  Target: ANGPTL3; (+) strand; PAM type: YTN; PAM sequence: TTA
atatgcaattaattttcacc

SEQ ID NO: 14211 - DNA, 20 bp, Artificial Sequence
  Description of Artificial Sequence: Synthetic oligonucleotide
  Target: ANGPTL3; (+) strand; PAM type: YTN; PAM sequence: TTA
attttcaccagtaaaatact

SEQ ID NO: 14212 - DNA, 20 bp, Artificial Sequence
  Description of Artificial Sequence: Synthetic oligonucleotide
  Target: ANGPTL3; (+) strand; PAM type: YTN; PAM sequence: TTT
tcaccagtaaaatactatag

SEQ ID NO: 14213 - DNA, 20 bp, Artificial Sequence
  Description of Artificial Sequence: Synthetic oligonucleotide
  Target: ANGPTL3; (+) strand; PAM type: YTN; PAM sequence: TTT
caccagtaaaatactatagt

SEQ ID NO: 14214 - DNA, 20 bp, Artificial Sequence
  Description of Artificial Sequence: Synthetic oligonucleotide
  Target: ANGPTL3; (+) strand; PAM type: YTN; PAM sequence: TTC
accagtaaaatactatagta

SEQ ID NO: 14215 - DNA, 20 bp, Artificial Sequence
  Description of Artificial Sequence: Synthetic oligonucleotide
  Target: ANGPTL3; (+) strand; PAM type: YTN; PAM sequence: CTA
tagtatgggtacaaatgcat

SEQ ID NO: 14216 - DNA, 20 bp, Artificial Sequence
  Description of Artificial Sequence: Synthetic oligonucleotide
  Target: ANGPTL3; (+) strand; PAM type: YTN; PAM sequence: TTG
attagttctaattacaaaaa

SEQ ID NO: 14217 - DNA, 20 bp, Artificial Sequence
  Description of Artificial Sequence: Synthetic oligonucleotide
  Target: ANGPTL3; (+) strand; PAM type: YTN; PAM sequence: TTA
gttctaattacaaaaatggc

SEQ ID NO: 14218 - DNA, 20 bp, Artificial Sequence
  Description of Artificial Sequence: Synthetic oligonucleotide
  Target: ANGPTL3; (+) strand; PAM type: YTN; PAM sequence: TTC
taattacaaaaatggctaat

SEQ ID NO: 14219 - DNA, 20 bp, Artificial Sequence
  Description of Artificial Sequence: Synthetic oligonucleotide
  Target: ANGPTL3; (+) strand; PAM type: YTN; PAM sequence: CTA
attacaaaaatggctaatat

SEQ ID NO: 14220 - DNA, 20 bp, Artificial Sequence
  Description of Artificial Sequence: Synthetic oligonucleotide
  Target: ANGPTL3; (+) strand; PAM type: YTN; PAM sequence: TTA
caaaaatggctaatatataa

SEQ ID NO: 14221 - DNA, 20 bp, Artificial Sequence
  Description of Artificial Sequence: Synthetic oligonucleotide
  Target: ANGPTL3; (+) strand; PAM type: YTN; PAM sequence: CTA
atatataatactgtgtagtg

SEQ ID NO: 14222 - DNA, 20 bp, Artificial Sequence
  Description of Artificial Sequence: Synthetic oligonucleotide
  Target: ANGPTL3; (+) strand; PAM type: YTN; PAM sequence: CTG
tgtagtgtttatgatacatc

SEQ ID NO: 14223 - DNA, 20 bp, Artificial Sequence
  Description of Artificial Sequence: Synthetic oligonucleotide
  Target: ANGPTL3; (+) strand; PAM type: YTN; PAM sequence: TTT
atgatacatcagataatgtt

SEQ ID NO: 14224 - DNA, 20 bp, Artificial Sequence
  Description of Artificial Sequence: Synthetic oligonucleotide
  Target: ANGPTL3; (+) strand; PAM type: YTN; PAM sequence: TTA
tgatacatcagataatgttc

SEQ ID NO: 14225 - DNA, 20 bp, Artificial Sequence
  Description of Artificial Sequence: Synthetic oligonucleotide
  Target: ANGPTL3; (+) strand; PAM type: YTN; PAM sequence: TTC
taagtgctctgaaaatataa

SEQ ID NO: 14226 - DNA, 20 bp, Artificial Sequence
  Description of Artificial Sequence: Synthetic oligonucleotide
  Target: ANGPTL3; (+) strand; PAM type: YTN; PAM sequence: CTA
agtgctctgaaaatataaac

SEQ ID NO: 14227 - DNA, 20 bp, Artificial Sequence
  Description of Artificial Sequence: Synthetic oligonucleotide
  Target: ANGPTL3; (+) strand; PAM type: YTN; PAM sequence: CTC
tgaaaatataaacttttaat

SEQ ID NO: 14228 - DNA, 20 bp, Artificial Sequence
  Description of Artificial Sequence: Synthetic oligonucleotide
  Target: ANGPTL3; (+) strand; PAM type: YTN; PAM sequence: CTG
aaaatataaacttttaatct

SEQ ID NO: 14229 - DNA, 20 bp, Artificial Sequence
  Description of Artificial Sequence: Synthetic oligonucleotide
  Target: ANGPTL3; (+) strand; PAM type: YTN; PAM sequence: CTT
ttaatcttttatacgaccct

SEQ ID NO: 14230 - DNA, 20 bp, Artificial Sequence
  Description of Artificial Sequence: Synthetic oligonucleotide
  Target: ANGPTL3; (+) strand; PAM type: YTN; PAM sequence: TTT
taatcttttatacgacccta

SEQ ID NO: 14231 - DNA, 20 bp, Artificial Sequence
  Description of Artificial Sequence: Synthetic oligonucleotide
  Target: ANGPTL3; (+) strand; PAM type: YTN; PAM sequence: TTT
aatcttttatacgaccctat

SEQ ID NO: 14232 - DNA, 20 bp, Artificial Sequence
  Description of Artificial Sequence: Synthetic oligonucleotide
  Target: ANGPTL3; (+) strand; PAM type: YTN; PAM sequence: TTA
atcttttatacgaccctata

SEQ ID NO: 14233 - DNA, 20 bp, Artificial Sequence
  Description of Artificial Sequence: Synthetic oligonucleotide
  Target: ANGPTL3; (+) strand; PAM type: YTN; PAM sequence: CTT
ttatacgaccctataaaata

SEQ ID NO: 14234 - DNA, 20 bp, Artificial Sequence
  Description of Artificial Sequence: Synthetic oligonucleotide
  Target: ANGPTL3; (+) strand; PAM type: YTN; PAM sequence: TTT
tatacgaccctataaaatag

SEQ ID NO: 14235 - DNA, 20 bp, Artificial Sequence
  Description of Artificial Sequence: Synthetic oligonucleotide
  Target: ANGPTL3; (+) strand; PAM type: YTN; PAM sequence: TTT
atacgaccctataaaatagg

SEQ ID NO: 14236 - DNA, 20 bp, Artificial Sequence
  Description of Artificial Sequence: Synthetic oligonucleotide
  Target: ANGPTL3; (+) strand; PAM type: YTN; PAM sequence: TTA
tacgaccctataaaataggt

SEQ ID NO: 14237 - DNA, 20 bp, Artificial Sequence
  Description of Artificial Sequence: Synthetic oligonucleotide
  Target: ANGPTL3; (+) strand; PAM type: YTN; PAM sequence: CTA
taaaataggtgttattctca

SEQ ID NO: 14238 - DNA, 20 bp, Artificial Sequence
  Description of Artificial Sequence: Synthetic oligonucleotide
  Target: ANGPTL3; (+) strand; PAM type: YTN; PAM sequence: TTA
ttctcactggagagatgaga

SEQ ID NO: 14239 - DNA, 20 bp, Artificial Sequence
  Description of Artificial Sequence: Synthetic oligonucleotide
  Target: ANGPTL3; (+) strand; PAM type: YTN; PAM sequence: TTC
tcactggagagatgagaaaa

SEQ ID NO: 14240 - DNA, 20 bp, Artificial Sequence
  Description of Artificial Sequence: Synthetic oligonucleotide
  Target: ANGPTL3; (+) strand; PAM type: YTN; PAM sequence: CTC
actggagagatgagaaaaca

SEQ ID NO: 14241 - DNA, 20 bp, Artificial Sequence
  Description of Artificial Sequence: Synthetic oligonucleotide
  Target: ANGPTL3; (+) strand; PAM type: YTN; PAM sequence: CTG
gagagatgagaaaacagggg

SEQ ID NO: 14242 - DNA, 20 bp, Artificial Sequence
  Description of Artificial Sequence: Synthetic oligonucleotide
  Target: ANGPTL3; (+) strand; PAM type: YTN; PAM sequence: TTC
agagatgtgaagtaatttga

SEQ ID NO: 14243 - DNA, 20 bp, Artificial Sequence
  Description of Artificial Sequence: Synthetic oligonucleotide
  Target: ANGPTL3; (+) strand; PAM type: YTN; PAM sequence: TTT
gaccaaaggtcacaaagctg

SEQ ID NO: 14244 - DNA, 20 bp, Artificial Sequence
  Description of Artificial Sequence: Synthetic oligonucleotide
  Target: ANGPTL3; (+) strand; PAM type: YTN; PAM sequence: TTG
accaaaggtcacaaagctga

SEQ ID NO: 14245 - DNA, 20 bp, Artificial Sequence
  Description of Artificial Sequence: Synthetic oligonucleotide
  Target: ANGPTL3; (+) strand; PAM type: YTN; PAM sequence: CTG
aagaatatgaaatccgggat

SEQ ID NO: 14246 - DNA, 20 bp, Artificial Sequence
  Description of Artificial Sequence: Synthetic oligonucleotide
  Target: ANGPTL3; (+) strand; PAM type: YTN; PAM sequence: TTC
tgattcaggcagtcttattc

SEQ ID NO: 14247 - DNA, 20 bp, Artificial Sequence
  Description of Artificial Sequence: Synthetic oligonucleotide
  Target: ANGPTL3; (+) strand; PAM type: YTN; PAM sequence: CTG
attcaggcagtcttattcca

SEQ ID NO: 14248 - DNA, 20 bp, Artificial Sequence
  Description of Artificial Sequence: Synthetic oligonucleotide
  Target: ANGPTL3; (+) strand; PAM type: YTN; PAM sequence: TTC
aggcagtcttattccagaat

SEQ ID NO: 14249 - DNA, 20 bp, Artificial Sequence
  Description of Artificial Sequence: Synthetic oligonucleotide
  Target: ANGPTL3; (+) strand; PAM type: YTN; PAM sequence: CTT
attccagaatcatgctctta

SEQ ID NO: 14250 - DNA, 20 bp, Artificial Sequence
  Description of Artificial Sequence: Synthetic oligonucleotide
  Target: ANGPTL3; (+) strand; PAM type: YTN; PAM sequence: TTA
ttccagaatcatgctcttaa

SEQ ID NO: 14251 - DNA, 20 bp, Artificial Sequence
  Description of Artificial Sequence: Synthetic oligonucleotide
  Target: ANGPTL3; (+) strand; PAM type: YTN; PAM sequence: TTC
cagaatcatgctcttaacca

SEQ ID NO: 14252 - DNA, 20 bp, Artificial Sequence
  Description of Artificial Sequence: Synthetic oligonucleotide
  Target: ANGPTL3; (+) strand; PAM type: YTN; PAM sequence: CTC
ttaaccactatggaatactg

SEQ ID NO: 14253 - DNA, 20 bp, Artificial Sequence
  Description of Artificial Sequence: Synthetic oligonucleotide
  Target: ANGPTL3; (+) strand; PAM type: YTN; PAM sequence: CTT
aaccactatggaatactgcc

SEQ ID NO: 14254 - DNA, 20 bp, Artificial Sequence
  Description of Artificial Sequence: Synthetic oligonucleotide
  Target: ANGPTL3; (+) strand; PAM type: YTN; PAM sequence: TTA
accactatggaatactgcct

SEQ ID NO: 14255 - DNA, 20 bp, Artificial Sequence
  Description of Artificial Sequence: Synthetic oligonucleotide
  Target: ANGPTL3; (+) strand; PAM type: YTN; PAM sequence: CTA
tggaatactgcctctactgt

SEQ ID NO: 14256 - DNA, 20 bp, Artificial Sequence
  Description of Artificial Sequence: Synthetic oligonucleotide
  Target: ANGPTL3; (+) strand; PAM type: YTN; PAM sequence: CTG
cctctactgtaactattata

SEQ ID NO: 14257 - DNA, 20 bp, Artificial Sequence
  Description of Artificial Sequence: Synthetic oligonucleotide
  Target: ANGPTL3; (+) strand; PAM type: YTN; PAM sequence: CTC
tactgtaactattataccca

SEQ ID NO: 14258 - DNA, 20 bp, Artificial Sequence
  Description of Artificial Sequence: Synthetic oligonucleotide
  Target: ANGPTL3; (+) strand; PAM type: YTN; PAM sequence: CTA
ctgtaactattatacccaaa

SEQ ID NO: 14259 - DNA, 20 bp, Artificial Sequence
  Description of Artificial Sequence: Synthetic oligonucleotide
  Target: ANGPTL3; (+) strand; PAM type: YTN; PAM sequence: CTG
taactattatacccaaaacc

SEQ ID NO: 14260 - DNA, 20 bp, Artificial Sequence
  Description of Artificial Sequence: Synthetic oligonucleotide
  Target: ANGPTL3; (+) strand; PAM type: YTN; PAM sequence: CTA
ttatacccaaaacccttaat

SEQ ID NO: 14261 - DNA, 20 bp, Artificial Sequence
  Description of Artificial Sequence: Synthetic oligonucleotide
  Target: ANGPTL3; (+) strand; PAM type: YTN; PAM sequence: TTA
tacccaaaacccttaatcct

SEQ ID NO: 14262 - DNA, 20 bp, Artificial Sequence
  Description of Artificial Sequence: Synthetic oligonucleotide
  Target: ANGPTL3; (+) strand; PAM type: YTN; PAM sequence: CTT
aatcctaagtcatcaaaagg

SEQ ID NO: 14263 - DNA, 20 bp, Artificial Sequence
  Description of Artificial Sequence: Synthetic oligonucleotide
  Target: ANGPTL3; (+) strand; PAM type: YTN; PAM sequence: TTA
atcctaagtcatcaaaagga

SEQ ID NO: 14264 - DNA, 20 bp, Artificial Sequence
  Description of Artificial Sequence: Synthetic oligonucleotide
  Target: ANGPTL3; (+) strand; PAM type: YTN; PAM sequence: CTA
agtcatcaaaaggaagagcc

SEQ ID NO: 14265 - DNA, 20 bp, Artificial Sequence
  Description of Artificial Sequence: Synthetic oligonucleotide
  Target: ANGPTL3; (+) strand; PAM type: YTN; PAM sequence: CTC
tattttacacaatgaagagg

SEQ ID NO: 14266 - DNA, 20 bp, Artificial Sequence
  Description of Artificial Sequence: Synthetic oligonucleotide
  Target: ANGPTL3; (+) strand; PAM type: YTN; PAM sequence: CTA
ttttacacaatgaagaggca

SEQ ID NO: 14267 - DNA, 20 bp, Artificial Sequence
  Description of Artificial Sequence: Synthetic oligonucleotide
  Target: ANGPTL3; (+) strand; PAM type: YTN; PAM sequence: TTT
tacacaatgaagaggcattt

SEQ ID NO: 14268 - DNA, 20 bp, Artificial Sequence
  Description of Artificial Sequence: Synthetic oligonucleotide
  Target: ANGPTL3; (+) strand; PAM type: YTN; PAM sequence: TTT
acacaatgaagaggcatttc

SEQ ID NO: 14269 - DNA, 20 bp, Artificial Sequence
  Description of Artificial Sequence: Synthetic oligonucleotide
  Target: ANGPTL3; (+) strand; PAM type: YTN; PAM sequence: TTA
cacaatgaagaggcatttct

SEQ ID NO: 14270 - DNA, 20 bp, Artificial Sequence
  Description of Artificial Sequence: Synthetic oligonucleotide
  Target: ANGPTL3; (+) strand; PAM type: YTN; PAM sequence: TTT
ctaagaatagaaatttaggg

SEQ ID NO: 14271 - DNA, 20 bp, Artificial Sequence
  Description of Artificial Sequence: Synthetic oligonucleotide
  Target: ANGPTL3; (+) strand; PAM type: YTN; PAM sequence: TTC
taagaatagaaatttaggga

SEQ ID NO: 14272 - DNA, 20 bp, Artificial Sequence
  Description of Artificial Sequence: Synthetic oligonucleotide
  Target: ANGPTL3; (+) strand; PAM type: YTN; PAM sequence: CTA
agaatagaaatttagggacg

SEQ ID NO: 14273 - DNA, 20 bp, Artificial Sequence
  Description of Artificial Sequence: Synthetic oligonucleotide
  Target: ANGPTL3; (+) strand; PAM type: YTN; PAM sequence: TTT
agggacgagcacagtggctt

SEQ ID NO: 14274 - DNA, 20 bp, Artificial Sequence
  Description of Artificial Sequence: Synthetic oligonucleotide
  Target: ANGPTL3; (+) strand; PAM type: YTN; PAM sequence: TTA
gggacgagcacagtggctta

SEQ ID NO: 14275 - DNA, 20 bp, Artificial Sequence
  Description of Artificial Sequence: Synthetic oligonucleotide
  Target: ANGPTL3; (+) strand; PAM type: YTN; PAM sequence: CTT
actcctttaatatcagcact

SEQ ID NO: 14276 - DNA, 20 bp, Artificial Sequence
  Description of Artificial Sequence: Synthetic oligonucleotide
  Target: ANGPTL3; (+) strand; PAM type: YTN; PAM sequence: TTA
ctcctttaatatcagcactt

SEQ ID NO: 14277 - DNA, 20 bp, Artificial Sequence
  Description of Artificial Sequence: Synthetic oligonucleotide
  Target: ANGPTL3; (+) strand; PAM type: YTN; PAM sequence: CTC
ctttaatatcagcactttga

SEQ ID NO: 14278 - DNA, 20 bp, Artificial Sequence
  Description of Artificial Sequence: Synthetic oligonucleotide
  Target: ANGPTL3; (+) strand; PAM type: YTN; PAM sequence: CTT
taatatcagcactttgagag

SEQ ID NO: 14279 - DNA, 20 bp, Artificial Sequence
  Description of Artificial Sequence: Synthetic oligonucleotide
  Target: ANGPTL3; (+) strand; PAM type: YTN; PAM sequence: TTT
aatatcagcactttgagagg

SEQ ID NO: 14280 - DNA, 20 bp, Artificial Sequence
  Description of Artificial Sequence: Synthetic oligonucleotide
  Target: ANGPTL3; (+) strand; PAM type: YTN; PAM sequence: TTA
atatcagcactttgagaggc

SEQ ID NO: 14281 - DNA, 20 bp, Artificial Sequence
  Description of Artificial Sequence: Synthetic oligonucleotide
  Target: ANGPTL3; (+) strand; PAM type: YTN; PAM sequence: CTT
tgagaggctgatatgggagg

SEQ ID NO: 14282 - DNA, 20 bp, Artificial Sequence
  Description of Artificial Sequence: Synthetic oligonucleotide
  Target: ANGPTL3; (+) strand; PAM type: YTN; PAM sequence: TTT
gagaggctgatatgggaggt

SEQ ID NO: 14283 - DNA, 20 bp, Artificial Sequence
  Description of Artificial Sequence: Synthetic oligonucleotide
  Target: ANGPTL3; (+) strand; PAM type: YTN; PAM sequence: TTG
agaggctgatatgggaggtt

SEQ ID NO: 14284 - DNA, 20 bp, Artificial Sequence
  Description of Artificial Sequence: Synthetic oligonucleotide
  Target: ANGPTL3; (+) strand; PAM type: YTN; PAM sequence: CTG
atatgggaggttcacttgaa

SEQ ID NO: 14285 - DNA, 20 bp, Artificial Sequence
  Description of Artificial Sequence: Synthetic oligonucleotide
  Target: ANGPTL3; (+) strand; PAM type: YTN; PAM sequence: TTC
acttgaagtcaggagttcaa

SEQ ID NO: 14286 - DNA, 20 bp, Artificial Sequence
  Description of Artificial Sequence: Synthetic oligonucleotide
  Target: ANGPTL3; (+) strand; PAM type: YTN; PAM sequence: CTT
gaagtcaggagttcaaggtc

SEQ ID NO: 14287 - DNA, 20 bp, Artificial Sequence
  Description of Artificial Sequence: Synthetic oligonucleotide
  Target: ANGPTL3; (+) strand; PAM type: YTN; PAM sequence: TTG
aagtcaggagttcaaggtca

SEQ ID NO: 14288 - DNA, 20 bp, Artificial Sequence
  Description of Artificial Sequence: Synthetic oligonucleotide
  Target: ANGPTL3; (+) strand; PAM type: YTN; PAM sequence: TTC
aaggtcagcttgggcaacat

SEQ ID NO: 14289 - DNA, 20 bp, Artificial Sequence
  Description of Artificial Sequence: Synthetic oligonucleotide
  Target: ANGPTL3; (+) strand; PAM type: YTN; PAM sequence: CTT
gggcaacatagtgaaacaca

SEQ ID NO: 14290 - DNA, 20 bp, Artificial Sequence
  Description of Artificial Sequence: Synthetic oligonucleotide
  Target: ANGPTL3; (+) strand; PAM type: YTN; PAM sequence: TTG
ggcaacatagtgaaacacag

SEQ ID NO: 14291 - DNA, 20 bp, Artificial Sequence
  Description of Artificial Sequence: Synthetic oligonucleotide
  Target: ANGPTL3; (+) strand; PAM type: YTN; PAM sequence: CTC
tacaaaatatttaaaaatta

SEQ ID NO: 14292 - DNA, 20 bp, Artificial Sequence
  Description of Artificial Sequence: Synthetic oligonucleotide
  Target: ANGPTL3; (+) strand; PAM type: YTN; PAM sequence: CTA
caaaatatttaaaaattagc

SEQ ID NO: 14293 - DNA, 20 bp, Artificial Sequence
  Description of Artificial Sequence: Synthetic oligonucleotide
  Target: ANGPTL3; (+) strand; PAM type: YTN; PAM sequence: TTT
aaaaattagctgggtgtggt

SEQ ID NO: 14294 - DNA, 20 bp, Artificial Sequence
  Description of Artificial Sequence: Synthetic oligonucleotide
  Target: ANGPTL3; (+) strand; PAM type: YTN; PAM sequence: TTA
aaaattagctgggtgtggtg

SEQ ID NO: 14295 - DNA, 20 bp, Artificial Sequence
  Description of Artificial Sequence: Synthetic oligonucleotide
  Target: ANGPTL3; (+) strand; PAM type: YTN; PAM sequence: TTA
gctgggtgtggtggcatgca

SEQ ID NO: 14296 - DNA, 20 bp, Artificial Sequence
  Description of Artificial Sequence: Synthetic oligonucleotide
  Target: ANGPTL3; (+) strand; PAM type: YTN; PAM sequence: CTG
ggtgtggtggcatgcatcta

SEQ ID NO: 14297 - DNA, 20 bp, Artificial Sequence
  Description of Artificial Sequence: Synthetic oligonucleotide
  Target: ANGPTL3; (+) strand; PAM type: YTN; PAM sequence: CTA
tagtctcagctacttgggag

SEQ ID NO: 14298 - DNA, 20 bp, Artificial Sequence
  Description of Artificial Sequence: Synthetic oligonucleotide
  Target: ANGPTL3; (+) strand; PAM type: YTN; PAM sequence: CTC
agctacttgggagacagagg

SEQ ID NO: 14299 - DNA, 20 bp, Artificial Sequence
  Description of Artificial Sequence: Synthetic oligonucleotide
  Target: ANGPTL3; (+) strand; PAM type: YTN; PAM sequence: CTA
cttgggagacagagggagga

SEQ ID NO: 14300 - DNA, 20 bp, Artificial Sequence
  Description of Artificial Sequence: Synthetic oligonucleotide
  Target: ANGPTL3; (+) strand; PAM type: YTN; PAM sequence: CTT
gggagacagagggaggaggc

SEQ ID NO: 14301 - DNA, 20 bp, Artificial Sequence
  Description of Artificial Sequence: Synthetic oligonucleotide
  Target: ANGPTL3; (+) strand; PAM type: YTN; PAM sequence: TTG
ggagacagagggaggaggct

SEQ ID NO: 14302 - DNA, 20 bp, Artificial Sequence
  Description of Artificial Sequence: Synthetic oligonucleotide
  Target: ANGPTL3; (+) strand; PAM type: YTN; PAM sequence: CTT
gctcgagcccaggagttcgt

SEQ ID NO: 14303 - DNA, 20 bp, Artificial Sequence
  Description of Artificial Sequence: Synthetic oligonucleotide
  Target: ANGPTL3; (+) strand; PAM type: YTN; PAM sequence: TTG
ctcgagcccaggagttcgtg

SEQ ID NO: 14304 - DNA, 20 bp, Artificial Sequence
  Description of Artificial Sequence: Synthetic oligonucleotide
  Target: ANGPTL3; (+) strand; PAM type: YTN; PAM sequence: CTC
gagcccaggagttcgtggct

SEQ ID NO: 14305 - DNA, 20 bp, Artificial Sequence
  Description of Artificial Sequence: Synthetic oligonucleotide
  Target: ANGPTL3; (+) strand; PAM type: YTN; PAM sequence: TTC
gtggctatagtgagctatga

SEQ ID NO: 14306 - DNA, 20 bp, Artificial Sequence
  Description of Artificial Sequence: Synthetic oligonucleotide
  Target: ANGPTL3; (+) strand; PAM type: YTN; PAM sequence: CTA
tagtgagctatgatcatgcc

SEQ ID NO: 14307 - DNA, 20 bp, Artificial Sequence
  Description of Artificial Sequence: Synthetic oligonucleotide
  Target: ANGPTL3; (+) strand; PAM type: YTN; PAM sequence: CTA
tgatcatgccactgcactcc

SEQ ID NO: 14308 - DNA, 20 bp, Artificial Sequence
  Description of Artificial Sequence: Synthetic oligonucleotide
  Target: ANGPTL3; (+) strand; PAM type: YTN; PAM sequence: CTG
cactccagcctggacaacag

SEQ ID NO: 14309 - DNA, 20 bp, Artificial Sequence
  Description of Artificial Sequence: Synthetic oligonucleotide
  Target: ANGPTL3; (+) strand; PAM type: YTN; PAM sequence: CTC
cagcctggacaacagagcaa

SEQ ID NO: 14310 - DNA, 20 bp, Artificial Sequence
  Description of Artificial Sequence: Synthetic oligonucleotide
  Target: ANGPTL3; (+) strand; PAM type: YTN; PAM sequence: CTG
gacaacagagcaagaccctg

SEQ ID NO: 14311 - DNA, 20 bp, Artificial Sequence
  Description of Artificial Sequence: Synthetic oligonucleotide
  Target: ANGPTL3; (+) strand; PAM type: YTN; PAM sequence: CTG
tctctaaaaaagaaaagaaa

SEQ ID NO: 14312 - DNA, 20 bp, Artificial Sequence
  Description of Artificial Sequence: Synthetic oligonucleotide
  Target: ANGPTL3; (+) strand; PAM type: YTN; PAM sequence: CTC
taaaaaagaaaagaaatttg

SEQ ID NO: 14313 - DNA, 20 bp, Artificial Sequence
  Description of Artificial Sequence: Synthetic oligonucleotide
  Target: ANGPTL3; (+) strand; PAM type: YTN; PAM sequence: CTA
aaaaagaaaagaaatttgga

SEQ ID NO: 14314 - DNA, 20 bp, Artificial Sequence
  Description of Artificial Sequence: Synthetic oligonucleotide
  Target: ANGPTL3; (+) strand; PAM type: YTN; PAM sequence: TTT
ggaaatggtttattttgtat

SEQ ID NO: 14315 - DNA, 20 bp, Artificial Sequence
  Description of Artificial Sequence: Synthetic oligonucleotide
  Target: ANGPTL3; (+) strand; PAM type: YTN; PAM sequence: TTG
gaaatggtttattttgtatt

SEQ ID NO: 14316 - DNA, 20 bp, Artificial Sequence
  Description of Artificial Sequence: Synthetic oligonucleotide
  Target: ANGPTL3; (+) strand; PAM type: YTN; PAM sequence: TTT
attttgtattaacaatttat

SEQ ID NO: 14317 - DNA, 20 bp, Artificial Sequence
  Description of Artificial Sequence: Synthetic oligonucleotide
  Target: ANGPTL3; (+) strand; PAM type: YTN; PAM sequence: TTA
ttttgtattaacaatttata

SEQ ID NO: 14318 - DNA, 20 bp, Artificial Sequence
  Description of Artificial Sequence: Synthetic oligonucleotide
  Target: ANGPTL3; (+) strand; PAM type: YTN; PAM sequence: TTT
tgtattaacaatttataatt

SEQ ID NO: 14319 - DNA, 20 bp, Artificial Sequence
  Description of Artificial Sequence: Synthetic oligonucleotide
  Target: ANGPTL3; (+) strand; PAM type: YTN; PAM sequence: TTT
gtattaacaatttataattt

SEQ ID NO: 14320 - DNA, 20 bp, Artificial Sequence
  Description of Artificial Sequence: Synthetic oligonucleotide
  Target: ANGPTL3; (+) strand; PAM type: YTN; PAM sequence: TTG
tattaacaatttataattta

SEQ ID NO: 14321 - DNA, 20 bp, Artificial Sequence
  Description of Artificial Sequence: Synthetic oligonucleotide
  Target: ANGPTL3; (+) strand; PAM type: YTN; PAM sequence: TTA
acaatttataatttacactg

SEQ ID NO: 14322 - DNA, 20 bp, Artificial Sequence
  Description of Artificial Sequence: Synthetic oligonucleotide
  Target: ANGPTL3; (+) strand; PAM type: YTN; PAM sequence: TTT
ataatttacactgaaattta

SEQ ID NO: 14323 - DNA, 20 bp, Artificial Sequence
  Description of Artificial Sequence: Synthetic oligonucleotide
  Target: ANGPTL3; (+) strand; PAM type: YTN; PAM sequence: TTA
taatttacactgaaatttat

SEQ ID NO: 14324 - DNA, 20 bp, Artificial Sequence
  Description of Artificial Sequence: Synthetic oligonucleotide
  Target: ANGPTL3; (+) strand; PAM type: YTN; PAM sequence: TTT
acactgaaatttattatgat

SEQ ID NO: 14325 - DNA, 20 bp, Artificial Sequence
  Description of Artificial Sequence: Synthetic oligonucleotide
  Target: ANGPTL3; (+) strand; PAM type: YTN; PAM sequence: TTA
cactgaaatttattatgata

SEQ ID NO: 14326 - DNA, 20 bp, Artificial Sequence
  Description of Artificial Sequence: Synthetic oligonucleotide
  Target: ANGPTL3; (+) strand; PAM type: YTN; PAM sequence: CTG
aaatttattatgataaaact

SEQ ID NO: 14327 - DNA, 20 bp, Artificial Sequence
  Description of Artificial Sequence: Synthetic oligonucleotide
  Target: ANGPTL3; (+) strand; PAM type: YTN; PAM sequence: TTT
attatgataaaacttttccc

SEQ ID NO: 14328 - DNA, 20 bp, Artificial Sequence
  Description of Artificial Sequence: Synthetic oligonucleotide
  Target: ANGPTL3; (+) strand; PAM type: YTN; PAM sequence: TTA
ttatgataaaacttttccct

SEQ ID NO: 14329 - DNA, 20 bp, Artificial Sequence
  Description of Artificial Sequence: Synthetic oligonucleotide
  Target: ANGPTL3; (+) strand; PAM type: YTN; PAM sequence: TTA
tgataaaacttttccctgtg

SEQ ID NO: 14330 - DNA, 20 bp, Artificial Sequence
  Description of Artificial Sequence: Synthetic oligonucleotide
  Target: ANGPTL3; (+) strand; PAM type: YTN; PAM sequence: CTT
ttccctgtgttaaaaagcta

SEQ ID NO: 14331 - DNA, 20 bp, Artificial Sequence
  Description of Artificial Sequence: Synthetic oligonucleotide
  Target: ANGPTL3; (+) strand; PAM type: YTN; PAM sequence: TTT
tccctgtgttaaaaagctat

SEQ ID NO: 14332 - DNA, 20 bp, Artificial Sequence
  Description of Artificial Sequence: Synthetic oligonucleotide
  Target: ANGPTL3; (+) strand; PAM type: YTN; PAM sequence: TTT
ccctgtgttaaaaagctatt

SEQ ID NO: 14333 - DNA, 20 bp, Artificial Sequence
  Description of Artificial Sequence: Synthetic oligonucleotide
  Target: ANGPTL3; (+) strand; PAM type: YTN; PAM sequence: TTC
cctgtgttaaaaagctatta

SEQ ID NO: 14334 - DNA, 20 bp, Artificial Sequence
  Description of Artificial Sequence: Synthetic oligonucleotide
  Target: ANGPTL3; (+) strand; PAM type: YTN; PAM sequence: CTG
tgttaaaaagctattaactt

SEQ ID NO: 14335 - DNA, 20 bp, Artificial Sequence
  Description of Artificial Sequence: Synthetic oligonucleotide
  Target: ANGPTL3; (+) strand; PAM type: YTN; PAM sequence: TTA
aaaagctattaactttatga

SEQ ID NO: 14336 - DNA, 20 bp, Artificial Sequence
  Description of Artificial Sequence: Synthetic oligonucleotide
  Target: ANGPTL3; (+) strand; PAM type: YTN; PAM sequence: CTA
ttaactttatgaaaaatttc

SEQ ID NO: 14337 - DNA, 20 bp, Artificial Sequence
  Description of Artificial Sequence: Synthetic oligonucleotide
  Target: ANGPTL3; (+) strand; PAM type: YTN; PAM sequence: TTA
actttatgaaaaatttcttt

SEQ ID NO: 14338 - DNA, 20 bp, Artificial Sequence
  Description of Artificial Sequence: Synthetic oligonucleotide
  Target: ANGPTL3; (+) strand; PAM type: YTN; PAM sequence: CTT
tatgaaaaatttcttttagg

SEQ ID NO: 14339 - DNA, 20 bp, Artificial Sequence
  Description of Artificial Sequence: Synthetic oligonucleotide
  Target: ANGPTL3; (+) strand; PAM type: YTN; PAM sequence: TTT
atgaaaaatttcttttaggt

SEQ ID NO: 14340 - DNA, 20 bp, Artificial Sequence
  Description of Artificial Sequence: Synthetic oligonucleotide
  Target: ANGPTL3; (+) strand; PAM type: YTN; PAM sequence: TTA
tgaaaaatttcttttaggta

SEQ ID NO: 14341 - DNA, 20 bp, Artificial Sequence
  Description of Artificial Sequence: Synthetic oligonucleotide
  Target: ANGPTL3; (+) strand; PAM type: YTN; PAM sequence: TTT
cttttaggtaaggttgatta

SEQ ID NO: 14342 - DNA, 20 bp, Artificial Sequence
  Description of Artificial Sequence: Synthetic oligonucleotide
  Target: ANGPTL3; (+) strand; PAM type: YTN; PAM sequence: TTC
ttttaggtaaggttgattat

SEQ ID NO: 14343 - DNA, 20 bp, Artificial Sequence
  Description of Artificial Sequence: Synthetic oligonucleotide
  Target: ANGPTL3; (+) strand; PAM type: YTN; PAM sequence: CTT
ttaggtaaggttgattatat

SEQ ID NO: 14344 - DNA, 20 bp, Artificial Sequence
  Description of Artificial Sequence: Synthetic oligonucleotide
  Target: ANGPTL3; (+) strand; PAM type: YTN; PAM sequence: TTT
taggtaaggttgattatata

SEQ ID NO: 14345 - DNA, 20 bp, Artificial Sequence
  Description of Artificial Sequence: Synthetic oligonucleotide
  Target: ANGPTL3; (+) strand; PAM type: YTN; PAM sequence: TTT
aggtaaggttgattatatat

SEQ ID NO: 14346 - DNA, 20 bp, Artificial Sequence
  Description of Artificial Sequence: Synthetic oligonucleotide
  Target: ANGPTL3; (+) strand; PAM type: YTN; PAM sequence: TTA
ggtaaggttgattatatata

SEQ ID NO: 14347 - DNA, 20 bp, Artificial Sequence
  Description of Artificial Sequence: Synthetic oligonucleotide
  Target: ANGPTL3; (+) strand; PAM type: YTN; PAM sequence: TTG
attatatatacccacacaca

SEQ ID NO: 14348 - DNA, 20 bp, Artificial Sequence
  Description of Artificial Sequence: Synthetic oligonucleotide
  Target: ANGPTL3; (+) strand; PAM type: YTN; PAM sequence: TTA
tatatacccacacacataca

SEQ ID NO: 14349 - DNA, 20 bp, Artificial Sequence
  Description of Artificial Sequence: Synthetic oligonucleotide
  Target: ANGPTL3; (+) strand; PAM type: YTN; PAM sequence: TTA
aaagttagtttcatgtgaca

SEQ ID NO: 14350 - DNA, 20 bp, Artificial Sequence
  Description of Artificial Sequence: Synthetic oligonucleotide
  Target: ANGPTL3; (+) strand; PAM type: YTN; PAM sequence: TTA
gtttcatgtgacataataac

SEQ ID NO: 14351 - DNA, 20 bp, Artificial Sequence
  Description of Artificial Sequence: Synthetic oligonucleotide
  Target: ANGPTL3; (+) strand; PAM type: YTN; PAM sequence: TTT
catgtgacataataactagc

SEQ ID NO: 14352 - DNA, 20 bp, Artificial Sequence
  Description of Artificial Sequence: Synthetic oligonucleotide
  Target: ANGPTL3; (+) strand; PAM type: YTN; PAM sequence: TTC
atgtgacataataactagca

SEQ ID NO: 14353 - DNA, 20 bp, Artificial Sequence
  Description of Artificial Sequence: Synthetic oligonucleotide
  Target: ANGPTL3; (+) strand; PAM type: YTN; PAM sequence: CTA
gcattttgagcactacctgt

SEQ ID NO: 14354 - DNA, 20 bp, Artificial Sequence
  Description of Artificial Sequence: Synthetic oligonucleotide
  Target: ANGPTL3; (+) strand; PAM type: YTN; PAM sequence: TTT
tgagcactacctgtttgccc

SEQ ID NO: 14355 - DNA, 20 bp, Artificial Sequence
  Description of Artificial Sequence: Synthetic oligonucleotide
  Target: ANGPTL3; (+) strand; PAM type: YTN; PAM sequence: TTT
gagcactacctgtttgccca

SEQ ID NO: 14356 - DNA, 20 bp, Artificial Sequence
  Description of Artificial Sequence: Synthetic oligonucleotide
  Target: ANGPTL3; (+) strand; PAM type: YTN; PAM sequence: TTG
agcactacctgtttgcccag

SEQ ID NO: 14357 - DNA, 20 bp, Artificial Sequence
  Description of Artificial Sequence: Synthetic oligonucleotide
  Target: ANGPTL3; (+) strand; PAM type: YTN; PAM sequence: CTA
cctgtttgcccagcactgtt

SEQ ID NO: 14358 - DNA, 20 bp, Artificial Sequence
  Description of Artificial Sequence: Synthetic oligonucleotide
  Target: ANGPTL3; (+) strand; PAM type: YTN; PAM sequence: CTG
tttgcccagcactgttctaa

SEQ ID NO: 14359 - DNA, 20 bp, Artificial Sequence
  Description of Artificial Sequence: Synthetic oligonucleotide
  Target: ANGPTL3; (+) strand; PAM type: YTN; PAM sequence: TTT
gcccagcactgttctaagtg

SEQ ID NO: 14360 - DNA, 20 bp, Artificial Sequence
  Description of Artificial Sequence: Synthetic oligonucleotide
  Target: ANGPTL3; (+) strand; PAM type: YTN; PAM sequence: TTG
cccagcactgttctaagtgc

SEQ ID NO: 14361 - DNA, 20 bp, Artificial Sequence
  Description of Artificial Sequence: Synthetic oligonucleotide
  Target: ANGPTL3; (+) strand; PAM type: YTN; PAM sequence: CTG
ttctaagtgctctacatgta

SEQ ID NO: 14362 - DNA, 20 bp, Artificial Sequence
  Description of Artificial Sequence: Synthetic oligonucleotide
  Target: ANGPTL3; (+) strand; PAM type: YTN; PAM sequence: TTC
taagtgctctacatgtatta

SEQ ID NO: 14363 - DNA, 20 bp, Artificial Sequence
  Description of Artificial Sequence: Synthetic oligonucleotide
  Target: ANGPTL3; (+) strand; PAM type: YTN; PAM sequence: CTA
agtgctctacatgtattatt

SEQ ID NO: 14364 - DNA, 20 bp, Artificial Sequence
  Description of Artificial Sequence: Synthetic oligonucleotide
  Target: ANGPTL3; (+) strand; PAM type: YTN; PAM sequence: CTC
tacatgtattattgttaaat

SEQ ID NO: 14365 - DNA, 20 bp, Artificial Sequence
  Description of Artificial Sequence: Synthetic oligonucleotide
  Target: ANGPTL3; (+) strand; PAM type: YTN; PAM sequence: CTA
catgtattattgttaaatta

SEQ ID NO: 14366 - DNA, 20 bp, Artificial Sequence
  Description of Artificial Sequence: Synthetic oligonucleotide
  Target: ANGPTL3; (+) strand; PAM type: YTN; PAM sequence: TTA
ttgttaaattatcataacac

SEQ ID NO: 14367 - DNA, 20 bp, Artificial Sequence
  Description of Artificial Sequence: Synthetic oligonucleotide
  Target: ANGPTL3; (+) strand; PAM type: YTN; PAM sequence: TTG
ttaaattatcataacactat

SEQ ID NO: 14368 - DNA, 20 bp, Artificial Sequence
  Description of Artificial Sequence: Synthetic oligonucleotide
  Target: ANGPTL3; (+) strand; PAM type: YTN; PAM sequence: TTA
aattatcataacactatgaa

SEQ ID NO: 14369 - DNA, 20 bp, Artificial Sequence
  Description of Artificial Sequence: Synthetic oligonucleotide
  Target: ANGPTL3; (+) strand; PAM type: YTN; PAM sequence: TTA
tcataacactatgaattatg

SEQ ID NO: 14370 - DNA, 20 bp, Artificial Sequence
  Description of Artificial Sequence: Synthetic oligonucleotide
  Target: ANGPTL3; (+) strand; PAM type: YTN; PAM sequence: CTA
tgaattatgtactataatta

SEQ ID NO: 14371 - DNA, 20 bp, Artificial Sequence
  Description of Artificial Sequence: Synthetic oligonucleotide
  Target: ANGPTL3; (+) strand; PAM type: YTN; PAM sequence: TTA
tgtactataattaccccagc

SEQ ID NO: 14372 - DNA, 20 bp, Artificial Sequence
  Description of Artificial Sequence: Synthetic oligonucleotide
  Target: ANGPTL3; (+) strand; PAM type: YTN; PAM sequence: CTA
taattaccccagctttacag

SEQ ID NO: 14373 - DNA, 20 bp, Artificial Sequence
  Description of Artificial Sequence: Synthetic oligonucleotide
  Target: ANGPTL3; (+) strand; PAM type: YTN; PAM sequence: TTA
ccccagctttacagatgagg

SEQ ID NO: 14374 - DNA, 20 bp, Artificial Sequence
  Description of Artificial Sequence: Synthetic oligonucleotide
  Target: ANGPTL3; (+) strand; PAM type: YTN; PAM sequence: CTT
tacagatgaggagactaatc

SEQ ID NO: 14375 - DNA, 20 bp, Artificial Sequence
  Description of Artificial Sequence: Synthetic oligonucleotide
  Target: ANGPTL3; (+) strand; PAM type: YTN; PAM sequence: TTT
acagatgaggagactaatcc

SEQ ID NO: 14376 - DNA, 20 bp, Artificial Sequence
  Description of Artificial Sequence: Synthetic oligonucleotide
  Target: ANGPTL3; (+) strand; PAM type: YTN; PAM sequence: TTA
cagatgaggagactaatcca

SEQ ID NO: 14377 - DNA, 20 bp, Artificial Sequence
  Description of Artificial Sequence: Synthetic oligonucleotide
  Target: ANGPTL3; (+) strand; PAM type: YTN; PAM sequence: CTA
atccatggggaggttaagta

SEQ ID NO: 14378 - DNA, 20 bp, Artificial Sequence
  Description of Artificial Sequence: Synthetic oligonucleotide
  Target: ANGPTL3; (+) strand; PAM type: YTN; PAM sequence: TTA
agtaacttgtccaaggccag

SEQ ID NO: 14379 - DNA, 20 bp, Artificial Sequence
  Description of Artificial Sequence: Synthetic oligonucleotide
  Target: ANGPTL3; (+) strand; PAM type: YTN; PAM sequence: CTT
gtccaaggccagacagctag

SEQ ID NO: 14380 - DNA, 20 bp, Artificial Sequence
  Description of Artificial Sequence: Synthetic oligonucleotide
  Target: ANGPTL3; (+) strand; PAM type: YTN; PAM sequence: TTG
tccaaggccagacagctaga

SEQ ID NO: 14381 - DNA, 20 bp, Artificial Sequence
  Description of Artificial Sequence: Synthetic oligonucleotide
  Target: ANGPTL3; (+) strand; PAM type: YTN; PAM sequence: CTA
gagccggcttttggacccac

SEQ ID NO: 14382 - DNA, 20 bp, Artificial Sequence
  Description of Artificial Sequence: Synthetic oligonucleotide
  Target: ANGPTL3; (+) strand; PAM type: YTN; PAM sequence: CTT
ttggacccacaccacagtct

SEQ ID NO: 14383 - DNA, 20 bp, Artificial Sequence
  Description of Artificial Sequence: Synthetic oligonucleotide
  Target: ANGPTL3; (+) strand; PAM type: YTN; PAM sequence: TTT
tggacccacaccacagtctg

SEQ ID NO: 14384 - DNA, 20 bp, Artificial Sequence
  Description of Artificial Sequence: Synthetic oligonucleotide
  Target: ANGPTL3; (+) strand; PAM type: YTN; PAM sequence: TTT
ggacccacaccacagtctga

SEQ ID NO: 14385 - DNA, 20 bp, Artificial Sequence
  Description of Artificial Sequence: Synthetic oligonucleotide
  Target: ANGPTL3; (+) strand; PAM type: YTN; PAM sequence: TTG
gacccacaccacagtctgac

SEQ ID NO: 14386 - DNA, 20 bp, Artificial Sequence
  Description of Artificial Sequence: Synthetic oligonucleotide
  Target: ANGPTL3; (+) strand; PAM type: YTN; PAM sequence: CTG
actccagcacccatattctt

SEQ ID NO: 14387 - DNA, 20 bp, Artificial Sequence
  Description of Artificial Sequence: Synthetic oligonucleotide
  Target: ANGPTL3; (+) strand; PAM type: YTN; PAM sequence: CTC
cagcacccatattcttaaca

SEQ ID NO: 14388 - DNA, 20 bp, Artificial Sequence
  Description of Artificial Sequence: Synthetic oligonucleotide
  Target: ANGPTL3; (+) strand; PAM type: YTN; PAM sequence: TTC
ttaacaatttcaccatatta

SEQ ID NO: 14389 - DNA, 20 bp, Artificial Sequence
  Description of Artificial Sequence: Synthetic oligonucleotide
  Target: ANGPTL3; (+) strand; PAM type: YTN; PAM sequence: CTT
aacaatttcaccatattaat

SEQ ID NO: 14390 - DNA, 20 bp, Artificial Sequence
  Description of Artificial Sequence: Synthetic oligonucleotide
  Target: ANGPTL3; (+) strand; PAM type: YTN; PAM sequence: TTA
acaatttcaccatattaata

SEQ ID NO: 14391 - DNA, 20 bp, Artificial Sequence
  Description of Artificial Sequence: Synthetic oligonucleotide
  Target: ANGPTL3; (+) strand; PAM type: YTN; PAM sequence: TTT
caccatattaatatgtcaag

SEQ ID NO: 14392 - DNA, 20 bp, Artificial Sequence
  Description of Artificial Sequence: Synthetic oligonucleotide
  Target: ANGPTL3; (+) strand; PAM type: YTN; PAM sequence: TTC
accatattaatatgtcaaga

SEQ ID NO: 14393 - DNA, 20 bp, Artificial Sequence
  Description of Artificial Sequence: Synthetic oligonucleotide
  Target: ANGPTL3; (+) strand; PAM type: YTN; PAM sequence: TTA
atatgtcaagattaagcagt

SEQ ID NO: 14394 - DNA, 20 bp, Artificial Sequence
  Description of Artificial Sequence: Synthetic oligonucleotide
  Target: ANGPTL3; (+) strand; PAM type: YTN; PAM sequence: TTA
agcagttttaaaggatgcta

SEQ ID NO: 14395 - DNA, 20 bp, Artificial Sequence
  Description of Artificial Sequence: Synthetic oligonucleotide
  Target: ANGPTL3; (+) strand; PAM type: YTN; PAM sequence: TTT
taaaggatgctattttctca

SEQ ID NO: 14396 - DNA, 20 bp, Artificial Sequence
  Description of Artificial Sequence: Synthetic oligonucleotide
  Target: ANGPTL3; (+) strand; PAM type: YTN; PAM sequence: TTT
aaaggatgctattttctcac

SEQ ID NO: 14397 - DNA, 20 bp, Artificial Sequence
  Description of Artificial Sequence: Synthetic oligonucleotide
  Target: ANGPTL3; (+) strand; PAM type: YTN; PAM sequence: TTA
aaggatgctattttctcaca

SEQ ID NO: 14398 - DNA, 20 bp, Artificial Sequence
  Description of Artificial Sequence: Synthetic oligonucleotide
  Target: ANGPTL3; (+) strand; PAM type: YTN; PAM sequence: CTA
ttttctcacaaatttcttaa

SEQ ID NO: 14399 - DNA, 20 bp, Artificial Sequence
  Description of Artificial Sequence: Synthetic oligonucleotide
  Target: ANGPTL3; (+) strand; PAM type: YTN; PAM sequence: TTT
tctcacaaatttcttaatat

SEQ ID NO: 14400 - DNA, 20 bp, Artificial Sequence
  Description of Artificial Sequence: Synthetic oligonucleotide
  Target: ANGPTL3; (+) strand; PAM type: YTN; PAM sequence: TTT
ctcacaaatttcttaatatg

SEQ ID NO: 14401 - DNA, 20 bp, Artificial Sequence
  Description of Artificial Sequence: Synthetic oligonucleotide
  Target: ANGPTL3; (+) strand; PAM type: YTN; PAM sequence: TTC
tcacaaatttcttaatatga

SEQ ID NO: 14402 - DNA, 20 bp, Artificial Sequence
  Description of Artificial Sequence: Synthetic oligonucleotide
  Target: ANGPTL3; (+) strand; PAM type: YTN; PAM sequence: CTC
acaaatttcttaatatgaac

SEQ ID NO: 14403 - DNA, 20 bp, Artificial Sequence
  Description of Artificial Sequence: Synthetic oligonucleotide
  Target: ANGPTL3; (+) strand; PAM type: YTN; PAM sequence: TTT
cttaatatgaacactcaata

SEQ ID NO: 14404 - DNA, 20 bp, Artificial Sequence
  Description of Artificial Sequence: Synthetic oligonucleotide
  Target: ANGPTL3; (+) strand; PAM type: YTN; PAM sequence: TTC
ttaatatgaacactcaataa

SEQ ID NO: 14405 - DNA, 20 bp, Artificial Sequence
  Description of Artificial Sequence: Synthetic oligonucleotide
  Target: ANGPTL3; (+) strand; PAM type: YTN; PAM sequence: CTT
aatatgaacactcaataaga

SEQ ID NO: 14406 - DNA, 20 bp, Artificial Sequence
  Description of Artificial Sequence: Synthetic oligonucleotide
  Target: ANGPTL3; (+) strand; PAM type: YTN; PAM sequence: TTA
atatgaacactcaataagaa

SEQ ID NO: 14407 - DNA, 20 bp, Artificial Sequence
  Description of Artificial Sequence: Synthetic oligonucleotide
  Target: ANGPTL3; (+) strand; PAM type: YTN; PAM sequence: CTC
aataagaataatcactaata

SEQ ID NO: 14408 - DNA, 20 bp, Artificial Sequence
  Description of Artificial Sequence: Synthetic oligonucleotide
  Target: ANGPTL3; (+) strand; PAM type: YTN; PAM sequence: CTA
atataagcatttagtatttt

SEQ ID NO: 14409 - DNA, 20 bp, Artificial Sequence
  Description of Artificial Sequence: Synthetic oligonucleotide
  Target: ANGPTL3; (+) strand; PAM type: YTN; PAM sequence: TTT
agtatttttttaacactaag

SEQ ID NO: 14410 - DNA, 20 bp, Artificial Sequence
  Description of Artificial Sequence: Synthetic oligonucleotide
  Target: ANGPTL3; (+) strand; PAM type: YTN; PAM sequence: TTA
gtatttttttaacactaagt

SEQ ID NO: 14411 - DNA, 20 bp, Artificial Sequence
  Description of Artificial Sequence: Synthetic oligonucleotide
  Target: ANGPTL3; (+) strand; PAM type: YTN; PAM sequence: TTT
ttttaacactaagttggaag

SEQ ID NO: 14412 - DNA, 20 bp, Artificial Sequence
  Description of Artificial Sequence: Synthetic oligonucleotide
  Target: ANGPTL3; (+) strand; PAM type: YTN; PAM sequence: TTT
tttaacactaagttggaagc

SEQ ID NO: 14413 - DNA, 20 bp, Artificial Sequence
  Description of Artificial Sequence: Synthetic oligonucleotide
  Target: ANGPTL3; (+) strand; PAM type: YTN; PAM sequence: TTT
ttaacactaagttggaagca

SEQ ID NO: 14414 - DNA, 20 bp, Artificial Sequence
  Description of Artificial Sequence: Synthetic oligonucleotide
  Target: ANGPTL3; (+) strand; PAM type: YTN; PAM sequence: TTT
taacactaagttggaagcat

SEQ ID NO: 14415 - DNA, 20 bp, Artificial Sequence
  Description of Artificial Sequence: Synthetic oligonucleotide
  Target: ANGPTL3; (+) strand; PAM type: YTN; PAM sequence: TTT
aacactaagttggaagcata

SEQ ID NO: 14416 - DNA, 20 bp, Artificial Sequence
  Description of Artificial Sequence: Synthetic oligonucleotide
  Target: ANGPTL3; (+) strand; PAM type: YTN; PAM sequence: TTA
acactaagttggaagcatag

SEQ ID NO: 14417 - DNA, 20 bp, Artificial Sequence
  Description of Artificial Sequence: Synthetic oligonucleotide
  Target: ANGPTL3; (+) strand; PAM type: YTN; PAM sequence: CTA
agttggaagcatagtggaac

SEQ ID NO: 14418 - DNA, 20 bp, Artificial Sequence
  Description of Artificial Sequence: Synthetic oligonucleotide
  Target: ANGPTL3; (+) strand; PAM type: YTN; PAM sequence: TTG
gaagcatagtggaacattta

SEQ ID NO: 14419 - DNA, 20 bp, Artificial Sequence
  Description of Artificial Sequence: Synthetic oligonucleotide
  Target: ANGPTL3; (+) strand; PAM type: YTN; PAM sequence: TTT
atttttagaaatattattaa

SEQ ID NO: 14420 - DNA, 20 bp, Artificial Sequence
  Description of Artificial Sequence: Synthetic oligonucleotide
  Target: ANGPTL3; (+) strand; PAM type: YTN; PAM sequence: TTA
tttttagaaatattattaat

SEQ ID NO: 14421 - DNA, 20 bp, Artificial Sequence
  Description of Artificial Sequence: Synthetic oligonucleotide
  Target: ANGPTL3; (+) strand; PAM type: YTN; PAM sequence: TTT
ttagaaatattattaattgg

SEQ ID NO: 14422 - DNA, 20 bp, Artificial Sequence
  Description of Artificial Sequence: Synthetic oligonucleotide
  Target: ANGPTL3; (+) strand; PAM type: YTN; PAM sequence: TTT
tagaaatattattaattggc

SEQ ID NO: 14423 - DNA, 20 bp, Artificial Sequence
  Description of Artificial Sequence: Synthetic oligonucleotide
  Target: ANGPTL3; (+) strand; PAM type: YTN; PAM sequence: TTT
agaaatattattaattggct

SEQ ID NO: 14424 - DNA, 20 bp, Artificial Sequence
  Description of Artificial Sequence: Synthetic oligonucleotide
  Target: ANGPTL3; (+) strand; PAM type: YTN; PAM sequence: TTA
gaaatattattaattggctg

SEQ ID NO: 14425 - DNA, 20 bp, Artificial Sequence
  Description of Artificial Sequence: Synthetic oligonucleotide
  Target: ANGPTL3; (+) strand; PAM type: YTN; PAM sequence: TTA
ttaattggctgggctcacgc

SEQ ID NO: 14426 - DNA, 20 bp, Artificial Sequence
  Description of Artificial Sequence: Synthetic oligonucleotide
  Target: ANGPTL3; (+) strand; PAM type: YTN; PAM sequence: TTA
attggctgggctcacgcttg

SEQ ID NO: 14427 - DNA, 20 bp, Artificial Sequence
  Description of Artificial Sequence: Synthetic oligonucleotide
  Target: ANGPTL3; (+) strand; PAM type: YTN; PAM sequence: TTG
gctgggctcacgcttgtaat

SEQ ID NO: 14428 - DNA, 20 bp, Artificial Sequence
  Description of Artificial Sequence: Synthetic oligonucleotide
  Target: ANGPTL3; (+) strand; PAM type: YTN; PAM sequence: CTG
ggctcacgcttgtaatcggc

SEQ ID NO: 14429 - DNA, 20 bp, Artificial Sequence
  Description of Artificial Sequence: Synthetic oligonucleotide
  Target: ANGPTL3; (+) strand; PAM type: YTN; PAM sequence: CTC
acgcttgtaatcggctgggc

SEQ ID NO: 14430 - DNA, 20 bp, Artificial Sequence
  Description of Artificial Sequence: Synthetic oligonucleotide
  Target: ANGPTL3; (+) strand; PAM type: YTN; PAM sequence: CTT
gtaatcggctgggctcatgc

SEQ ID NO: 14431 - DNA, 20 bp, Artificial Sequence
  Description of Artificial Sequence: Synthetic oligonucleotide
  Target: ANGPTL3; (+) strand; PAM type: YTN; PAM sequence: TTG
taatcggctgggctcatgcc

SEQ ID NO: 14432 - DNA, 20 bp, Artificial Sequence
  Description of Artificial Sequence: Synthetic oligonucleotide
  Target: ANGPTL3; (+) strand; PAM type: YTN; PAM sequence: CTG
ggctcatgcctgtaaatttt

SEQ ID NO: 14433 - DNA, 20 bp, Artificial Sequence
  Description of Artificial Sequence: Synthetic oligonucleotide
  Target: ANGPTL3; (+) strand; PAM type: YTN; PAM sequence: CTC
atgcctgtaaattttgggag

SEQ ID NO: 14434 - DNA, 20 bp, Artificial Sequence
  Description of Artificial Sequence: Synthetic oligonucleotide
  Target: ANGPTL3; (+) strand; PAM type: YTN; PAM sequence: CTG
taaattttgggaggccaagg

SEQ ID NO: 14435 - DNA, 20 bp, Artificial Sequence
  Description of Artificial Sequence: Synthetic oligonucleotide
  Target: ANGPTL3; (+) strand; PAM type: YTN; PAM sequence: TTT
tgggaggccaaggtaaaaga

SEQ ID NO: 14436 - DNA, 20 bp, Artificial Sequence
  Description of Artificial Sequence: Synthetic oligonucleotide
  Target: ANGPTL3; (+) strand; PAM type: YTN; PAM sequence: TTT
gggaggccaaggtaaaagaa

SEQ ID NO: 14437 - DNA, 20 bp, Artificial Sequence
  Description of Artificial Sequence: Synthetic oligonucleotide
  Target: ANGPTL3; (+) strand; PAM type: YTN; PAM sequence: TTG
ggaggccaaggtaaaagaat

SEQ ID NO: 14438 - DNA, 20 bp, Artificial Sequence
  Description of Artificial Sequence: Synthetic oligonucleotide
  Target: ANGPTL3; (+) strand; PAM type: YTN; PAM sequence: TTG
cttgagcccagtatttccag

SEQ ID NO: 14439 - DNA, 20 bp, Artificial Sequence
  Description of Artificial Sequence: Synthetic oligonucleotide
  Target: ANGPTL3; (+) strand; PAM type: YTN; PAM sequence: CTT
gagcccagtatttccagacc

SEQ ID NO: 14440 - DNA, 20 bp, Artificial Sequence
  Description of Artificial Sequence: Synthetic oligonucleotide
  Target: ANGPTL3; (+) strand; PAM type: YTN; PAM sequence: TTG
agcccagtatttccagacca

SEQ ID NO: 14441 - DNA, 20 bp, Artificial Sequence
  Description of Artificial Sequence: Synthetic oligonucleotide
  Target: ANGPTL3; (+) strand; PAM type: YTN; PAM sequence: TTT
ccagaccagcatgggcaata

SEQ ID NO: 14442 - DNA, 20 bp, Artificial Sequence
  Description of Artificial Sequence: Synthetic oligonucleotide
  Target: ANGPTL3; (+) strand; PAM type: YTN; PAM sequence: TTC
cagaccagcatgggcaatac

SEQ ID NO: 14443 - DNA, 20 bp, Artificial Sequence
  Description of Artificial Sequence: Synthetic oligonucleotide
  Target: ANGPTL3; (+) strand; PAM type: YTN; PAM sequence: TTA
agacatcatctttaaaaaaa

SEQ ID NO: 14444 - DNA, 20 bp, Artificial Sequence
  Description of Artificial Sequence: Synthetic oligonucleotide
  Target: ANGPTL3; (+) strand; PAM type: YTN; PAM sequence: CTT
taaaaaaaaaatgttattaa

SEQ ID NO: 14445 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaaaaaatgttattaat

SEQ ID NO: 14446 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaaaaatgttattaatc

SEQ ID NO: 14447 - DNA, 20 bp, Artificial Sequence
  Description of Artificial Sequence: Synthetic oligonucleotide
  Target: ANGPTL3; (+) strand; PAM type: YTN; PAM sequence: TTA
ttaatctcctctttttgtta

SEQ ID NO: 14448 - DNA, 20 bp, Artificial Sequence
  Description of Artificial Sequence: Synthetic oligonucleotide
  Target: ANGPTL3; (+) strand; PAM type: YTN; PAM sequence: TTA
atctcctctttttgttaaat

SEQ ID NO: 14449 - DNA, 20 bp, Artificial Sequence
  Description of Artificial Sequence: Synthetic oligonucleotide
  Target: ANGPTL3; (+) strand; PAM type: YTN; PAM sequence: CTC
ctctttttgttaaatgtata

SEQ ID NO: 14450 - DNA, 20 bp, Artificial Sequence
  Description of Artificial Sequence: Synthetic oligonucleotide
  Target: ANGPTL3; (+) strand; PAM type: YTN; PAM sequence: CTC
tttttgttaaatgtatatta

SEQ ID NO: 14451 - DNA, 20 bp, Artificial Sequence
  Description of Artificial Sequence: Synthetic oligonucleotide
  Target: ANGPTL3; (+) strand; PAM type: YTN; PAM sequence: CTT
tttgttaaatgtatattatc

SEQ ID NO: 14452 - DNA, 20 bp, Artificial Sequence
  Description of Artificial Sequence: Synthetic oligonucleotide
  Target: ANGPTL3; (+) strand; PAM type: YTN; PAM sequence: TTT
ttgttaaatgtatattatca

SEQ ID NO: 14453 - DNA, 20 bp, Artificial Sequence
  Description of Artificial Sequence: Synthetic oligonucleotide
  Target: ANGPTL3; (+) strand; PAM type: YTN; PAM sequence: TTT
tgttaaatgtatattatcaa

SEQ ID NO: 14454 - DNA, 20 bp, Artificial Sequence
  Description of Artificial Sequence: Synthetic oligonucleotide
  Target: ANGPTL3; (+) strand; PAM type: YTN; PAM sequence: TTT
gttaaatgtatattatcaaa

SEQ ID NO: 14455 - DNA, 20 bp, Artificial Sequence
  Description of Artificial Sequence: Synthetic oligonucleotide
  Target: ANGPTL3; (+) strand; PAM type: YTN; PAM sequence: TTG
ttaaatgtatattatcaaaa

SEQ ID NO: 14456 - DNA, 20 bp, Artificial Sequence
  Description of Artificial Sequence: Synthetic oligonucleotide
  Target: ANGPTL3; (+) strand; PAM type: YTN; PAM sequence: TTA
aatgtatattatcaaaattg

SEQ ID NO: 14457 - DNA, 20 bp, Artificial Sequence
  Description of Artificial Sequence: Synthetic oligonucleotide
  Target: ANGPTL3; (+) strand; PAM type: YTN; PAM sequence: TTA
tcaaaattgttactaagcta

SEQ ID NO: 14458 - DNA, 20 bp, Artificial Sequence
  Description of Artificial Sequence: Synthetic oligonucleotide
  Target: ANGPTL3; (+) strand; PAM type: YTN; PAM sequence: TTG
ttactaagctaacaaacttc

SEQ ID NO: 14459 - DNA, 20 bp, Artificial Sequence
  Description of Artificial Sequence: Synthetic oligonucleotide
  Target: ANGPTL3; (+) strand; PAM type: YTN; PAM sequence: TTA
ctaagctaacaaacttcaga

SEQ ID NO: 14460 - DNA, 20 bp, Artificial Sequence
  Description of Artificial Sequence: Synthetic oligonucleotide
  Target: ANGPTL3; (+) strand; PAM type: YTN; PAM sequence: CTA
agctaacaaacttcagaaaa

SEQ ID NO: 14461 - DNA, 20 bp, Artificial Sequence
  Description of Artificial Sequence: Synthetic oligonucleotide
  Target: ANGPTL3; (+) strand; PAM type: YTN; PAM sequence: CTA
acaaacttcagaaaaactta

SEQ ID NO: 14462 - DNA, 20 bp, Artificial Sequence
  Description of Artificial Sequence: Synthetic oligonucleotide
  Target: ANGPTL3; (+) strand; PAM type: YTN; PAM sequence: CTT
cagaaaaacttatgatgggc

SEQ ID NO: 14463 - DNA, 20 bp, Artificial Sequence
  Description of Artificial Sequence: Synthetic oligonucleotide
  Target: ANGPTL3; (+) strand; PAM type: YTN; PAM sequence: TTC
agaaaaacttatgatgggca

SEQ ID NO: 14464 - DNA, 20 bp, Artificial Sequence
  Description of Artificial Sequence: Synthetic oligonucleotide
  Target: ANGPTL3; (+) strand; PAM type: YTN; PAM sequence: CTT
atgatgggcaagctgcttgt

SEQ ID NO: 14465 - DNA, 20 bp, Artificial Sequence
  Description of Artificial Sequence: Synthetic oligonucleotide
  Target: ANGPTL3; (+) strand; PAM type: YTN; PAM sequence: TTA
tgatgggcaagctgcttgtg

SEQ ID NO: 14466 - DNA, 20 bp, Artificial Sequence
  Description of Artificial Sequence: Synthetic oligonucleotide
  Target: ANGPTL3; (+) strand; PAM type: YTN; PAM sequence: CTG
cttgtgacattgaaggtatt

SEQ ID NO: 14467 - DNA, 20 bp, Artificial Sequence
  Description of Artificial Sequence: Synthetic oligonucleotide
  Target: ANGPTL3; (+) strand; PAM type: YTN; PAM sequence: CTT
gtgacattgaaggtatttaa

SEQ ID NO: 14468 - DNA, 20 bp, Artificial Sequence
  Description of Artificial Sequence: Synthetic oligonucleotide
  Target: ANGPTL3; (+) strand; PAM type: YTN; PAM sequence: TTG
tgacattgaaggtatttaag

SEQ ID NO: 14469 - DNA, 20 bp, Artificial Sequence
  Description of Artificial Sequence: Synthetic oligonucleotide
  Target: ANGPTL3; (+) strand; PAM type: YTN; PAM sequence: TTG
aaggtatttaagattcaatt

SEQ ID NO: 14470 - DNA, 20 bp, Artificial Sequence
  Description of Artificial Sequence: Synthetic oligonucleotide
  Target: ANGPTL3; (+) strand; PAM type: YTN; PAM sequence: TTT
aagattcaattctagtttgg

SEQ ID NO: 14471 - DNA, 20 bp, Artificial Sequence
  Description of Artificial Sequence: Synthetic oligonucleotide
  Target: ANGPTL3; (+) strand; PAM type: YTN; PAM sequence: TTA
agattcaattctagtttggt

SEQ ID NO: 14472 - DNA, 20 bp, Artificial Sequence
  Description of Artificial Sequence: Synthetic oligonucleotide
  Target: ANGPTL3; (+) strand; PAM type: YTN; PAM sequence: TTC
aattctagtttggtcctaga

SEQ ID NO: 14473 - DNA, 20 bp, Artificial Sequence
  Description of Artificial Sequence: Synthetic oligonucleotide
  Target: ANGPTL3; (+) strand; PAM type: YTN; PAM sequence: TTC
tagtttggtcctagatgacc

SEQ ID NO: 14474 - DNA, 20 bp, Artificial Sequence
  Description of Artificial Sequence: Synthetic oligonucleotide
  Target: ANGPTL3; (+) strand; PAM type: YTN; PAM sequence: CTA
gtttggtcctagatgaccac

SEQ ID NO: 14475 - DNA, 20 bp, Artificial Sequence
  Description of Artificial Sequence: Synthetic oligonucleotide
  Target: ANGPTL3; (+) strand; PAM type: YTN; PAM sequence: TTT
ggtcctagatgaccacatat

SEQ ID NO: 14476 - DNA, 20 bp, Artificial Sequence
  Description of Artificial Sequence: Synthetic oligonucleotide
  Target: ANGPTL3; (+) strand; PAM type: YTN; PAM sequence: TTG
gtcctagatgaccacatatc

SEQ ID NO: 14477 - DNA, 20 bp, Artificial Sequence
  Description of Artificial Sequence: Synthetic oligonucleotide
  Target: ANGPTL3; (+) strand; PAM type: YTN; PAM sequence: CTA
gatgaccacatatccattgt

SEQ ID NO: 14478 - DNA, 20 bp, Artificial Sequence
  Description of Artificial Sequence: Synthetic oligonucleotide
  Target: ANGPTL3; (+) strand; PAM type: YTN; PAM sequence: TTG
ttccttcaacgagcacatgg

SEQ ID NO: 14479 - DNA, 20 bp, Artificial Sequence
  Description of Artificial Sequence: Synthetic oligonucleotide
  Target: ANGPTL3; (+) strand; PAM type: YTN; PAM sequence: TTC
cttcaacgagcacatggtaa

SEQ ID NO: 14480 - DNA, 20 bp, Artificial Sequence
  Description of Artificial Sequence: Synthetic oligonucleotide
  Target: ANGPTL3; (+) strand; PAM type: YTN; PAM sequence: CTT
caacgagcacatggtaaaga

SEQ ID NO: 14481 - DNA, 20 bp, Artificial Sequence
  Description of Artificial Sequence: Synthetic oligonucleotide
  Target: ANGPTL3; (+) strand; PAM type: YTN; PAM sequence: TTC
aacgagcacatggtaaagag

SEQ ID NO: 14482 - DNA, 20 bp, Artificial Sequence
  Description of Artificial Sequence: Synthetic oligonucleotide
  Target: ANGPTL3; (+) strand; PAM type: YTN; PAM sequence: CTA
gaacacagagacacagaaca

SEQ ID NO: 14483 - DNA, 20 bp, Artificial Sequence
  Description of Artificial Sequence: Synthetic oligonucleotide
  Target: ANGPTL3; (+) strand; PAM type: YTN; PAM sequence: CTT
taatgacacttactatatat

SEQ ID NO: 14484 - DNA, 20 bp, Artificial Sequence
  Description of Artificial Sequence: Synthetic oligonucleotide
  Target: ANGPTL3; (+) strand; PAM type: YTN; PAM sequence: TTT
aatgacacttactatatatg

SEQ ID NO: 14485 - DNA, 20 bp, Artificial Sequence
  Description of Artificial Sequence: Synthetic oligonucleotide
  Target: ANGPTL3; (+) strand; PAM type: YTN; PAM sequence: TTA
atgacacttactatatatgg

SEQ ID NO: 14486 - DNA, 20 bp, Artificial Sequence
  Description of Artificial Sequence: Synthetic oligonucleotide
  Target: ANGPTL3; (+) strand; PAM type: YTN; PAM sequence: CTT
actatatatgggattttgtg

SEQ ID NO: 14487 - DNA, 20 bp, Artificial Sequence
  Description of Artificial Sequence: Synthetic oligonucleotide
  Target: ANGPTL3; (+) strand; PAM type: YTN; PAM sequence: TTA
ctatatatgggattttgtga

SEQ ID NO: 14488 - DNA, 20 bp, Artificial Sequence
  Description of Artificial Sequence: Synthetic oligonucleotide
  Target: ANGPTL3; (+) strand; PAM type: YTN; PAM sequence: CTA
tatatgggattttgtgacaa

SEQ ID NO: 14489 - DNA, 20 bp, Artificial Sequence
  Description of Artificial Sequence: Synthetic oligonucleotide
  Target: ANGPTL3; (+) strand; PAM type: YTN; PAM sequence: TTT
tgtgacaatatacaaggatg

SEQ ID NO: 14490 - DNA, 20 bp, Artificial Sequence
  Description of Artificial Sequence: Synthetic oligonucleotide
  Target: ANGPTL3; (+) strand; PAM type: YTN; PAM sequence: TTT
gtgacaatatacaaggatgg

SEQ ID NO: 14491 - DNA, 20 bp, Artificial Sequence
  Description of Artificial Sequence: Synthetic oligonucleotide
  Target: ANGPTL3; (+) strand; PAM type: YTN; PAM sequence: TTG
tgacaatatacaaggatggt

SEQ ID NO: 14492 - DNA, 20 bp, Artificial Sequence
  Description of Artificial Sequence: Synthetic oligonucleotide
  Target: ANGPTL3; (+) strand; PAM type: YTN; PAM sequence: TTA
agacatataaggtgatgcaa

SEQ ID NO: 14493 - DNA, 20 bp, Artificial Sequence
  Description of Artificial Sequence: Synthetic oligonucleotide
  Target: ANGPTL3; (+) strand; PAM type: YTN; PAM sequence: TTA
acaattatagtgacaaaaaa

SEQ ID NO: 14494 - DNA, 20 bp, Artificial Sequence
  Description of Artificial Sequence: Synthetic oligonucleotide
  Target: ANGPTL3; (+) strand; PAM type: YTN; PAM sequence: TTA
tagtgacaaaaaatgaggag

SEQ ID NO: 14495 - DNA, 20 bp, Artificial Sequence
  Description of Artificial Sequence: Synthetic oligonucleotide
  Target: ANGPTL3; (+) strand; PAM type: YTN; PAM sequence: TTA
tacattgatttatacagagt

SEQ ID NO: 14496 - DNA, 20 bp, Artificial Sequence
  Description of Artificial Sequence: Synthetic oligonucleotide
  Target: ANGPTL3; (+) strand; PAM type: YTN; PAM sequence: TTG
atttatacagagtaccagag

SEQ ID NO: 14497 - DNA, 20 bp, Artificial Sequence
  Description of Artificial Sequence: Synthetic oligonucleotide
  Target: ANGPTL3; (+) strand; PAM type: YTN; PAM sequence: TTT
atacagagtaccagaggaac

SEQ ID NO: 14498 - DNA, 20 bp, Artificial Sequence
  Description of Artificial Sequence: Synthetic oligonucleotide
  Target: ANGPTL3; (+) strand; PAM type: YTN; PAM sequence: TTA
tacagagtaccagaggaaca

SEQ ID NO: 14499 - DNA, 20 bp, Artificial Sequence
  Description of Artificial Sequence: Synthetic oligonucleotide
  Target: ANGPTL3; (+) strand; PAM type: YTN; PAM sequence: TTG
agagccgtaacaccacctga

SEQ ID NO: 14500 - DNA, 20 bp, Artificial Sequence
  Description of Artificial Sequence: Synthetic oligonucleotide
  Target: ANGPTL3; (+) strand; PAM type: YTN; PAM sequence: CTG
agggagtggagaaaggcttc

SEQ ID NO: 14501 - DNA, 20 bp, Artificial Sequence
  Description of Artificial Sequence: Synthetic oligonucleotide
  Target: ANGPTL3; (+) strand; PAM type: YTN; PAM sequence: CTT
cagagagaaagtgttttttg

SEQ ID NO: 14502 - DNA, 20 bp, Artificial Sequence
  Description of Artificial Sequence: Synthetic oligonucleotide
  Target: ANGPTL3; (+) strand; PAM type: YTN; PAM sequence: TTC
agagagaaagtgttttttgg

SEQ ID NO: 14503 - DNA, 20 bp, Artificial Sequence
  Description of Artificial Sequence: Synthetic oligonucleotide
  Target: ANGPTL3; (+) strand; PAM type: YTN; PAM sequence: TTT
tttggaatggatcactgttt

SEQ ID NO: 14504 - DNA, 20 bp, Artificial Sequence
  Description of Artificial Sequence: Synthetic oligonucleotide
  Target: ANGPTL3; (+) strand; PAM type: YTN; PAM sequence: TTT
ttggaatggatcactgtttc

SEQ ID NO: 14505 - DNA, 20 bp, Artificial Sequence
  Description of Artificial Sequence: Synthetic oligonucleotide
  Target: ANGPTL3; (+) strand; PAM type: YTN; PAM sequence: TTT
tggaatggatcactgtttcc

SEQ ID NO: 14506 - DNA, 20 bp, Artificial Sequence
  Description of Artificial Sequence: Synthetic oligonucleotide
  Target: ANGPTL3; (+) strand; PAM type: YTN; PAM sequence: TTT
ggaatggatcactgtttcca

SEQ ID NO: 14507 - DNA, 20 bp, Artificial Sequence
  Description of Artificial Sequence: Synthetic oligonucleotide
  Target: ANGPTL3; (+) strand; PAM type: YTN; PAM sequence: TTG
gaatggatcactgtttccaa

SEQ ID NO: 14508 - DNA, 20 bp, Artificial Sequence
  Description of Artificial Sequence: Synthetic oligonucleotide
  Target: ANGPTL3; (+) strand; PAM type: YTN; PAM sequence: CTG
tttccaaaagaactaaagta

SEQ ID NO: 14509 - DNA, 20 bp, Artificial Sequence
  Description of Artificial Sequence: Synthetic oligonucleotide
  Target: ANGPTL3; (+) strand; PAM type: YTN; PAM sequence: TTT
ccaaaagaactaaagtacag

SEQ ID NO: 14510 - DNA, 20 bp, Artificial Sequence
  Description of Artificial Sequence: Synthetic oligonucleotide
  Target: ANGPTL3; (+) strand; PAM type: YTN; PAM sequence: TTC
caaaagaactaaagtacagt

SEQ ID NO: 14511 - DNA, 20 bp, Artificial Sequence
  Description of Artificial Sequence: Synthetic oligonucleotide
  Target: ANGPTL3; (+) strand; PAM type: YTN; PAM sequence: CTA
aagtacagtttgagaaatgc

SEQ ID NO: 14512 - DNA, 20 bp, Artificial Sequence
  Description of Artificial Sequence: Synthetic oligonucleotide
  Target: ANGPTL3; (+) strand; PAM type: YTN; PAM sequence: TTT
gagaaatgcatacttaattc

SEQ ID NO: 14513 - DNA, 20 bp, Artificial Sequence
  Description of Artificial Sequence: Synthetic oligonucleotide
  Target: ANGPTL3; (+) strand; PAM type: YTN; PAM sequence: TTG
agaaatgcatacttaattca

SEQ ID NO: 14514 - DNA, 20 bp, Artificial Sequence
  Description of Artificial Sequence: Synthetic oligonucleotide
  Target: ANGPTL3; (+) strand; PAM type: YTN; PAM sequence: CTT
aattcattacttttttcccc

SEQ ID NO: 14515 - DNA, 20 bp, Artificial Sequence
  Description of Artificial Sequence: Synthetic oligonucleotide
  Target: ANGPTL3; (+) strand; PAM type: YTN; PAM sequence: TTA
attcattacttttttcccct

SEQ ID NO: 14516 - DNA, 20 bp, Artificial Sequence
  Description of Artificial Sequence: Synthetic oligonucleotide
  Target: ANGPTL3; (+) strand; PAM type: YTN; PAM sequence: TTC
attacttttttcccctcaac

SEQ ID NO: 14517 - DNA, 20 bp, Artificial Sequence
  Description of Artificial Sequence: Synthetic oligonucleotide
  Target: ANGPTL3; (+) strand; PAM type: YTN; PAM sequence: TTA
cttttttcccctcaacttta

SEQ ID NO: 14518 - DNA, 20 bp, Artificial Sequence
  Description of Artificial Sequence: Synthetic oligonucleotide
  Target: ANGPTL3; (+) strand; PAM type: YTN; PAM sequence: CTT
ttttcccctcaactttaata

SEQ ID NO: 14519 - DNA, 20 bp, Artificial Sequence
  Description of Artificial Sequence: Synthetic oligonucleotide
  Target: ANGPTL3; (+) strand; PAM type: YTN; PAM sequence: TTT
tttcccctcaactttaataa

SEQ ID NO: 14520 - DNA, 20 bp, Artificial Sequence
  Description of Artificial Sequence: Synthetic oligonucleotide
  Target: ANGPTL3; (+) strand; PAM type: YTN; PAM sequence: TTT
ttcccctcaactttaataat

SEQ ID NO: 14521 - DNA, 20 bp, Artificial Sequence
  Description of Artificial Sequence: Synthetic oligonucleotide
  Target: ANGPTL3; (+) strand; PAM type: YTN; PAM sequence: TTT
tcccctcaactttaataata

SEQ ID NO: 14522 - DNA, 20 bp, Artificial Sequence
  Description of Artificial Sequence: Synthetic oligonucleotide
  Target: ANGPTL3; (+) strand; PAM type: YTN; PAM sequence: TTT
cccctcaactttaataataa

SEQ ID NO: 14523 - DNA, 20 bp, Artificial Sequence
  Description of Artificial Sequence: Synthetic oligonucleotide
  Target: ANGPTL3; (+) strand; PAM type: YTN; PAM sequence: TTC
ccctcaactttaataataaa

SEQ ID NO: 14524 - DNA, 20 bp, Artificial Sequence
  Description of Artificial Sequence: Synthetic oligonucleotide
  Target: ANGPTL3; (+) strand; PAM type: YTN; PAM sequence: CTC
aactttaataataaatttac

SEQ ID NO: 14525 - DNA, 20 bp, Artificial Sequence
  Description of Artificial Sequence: Synthetic oligonucleotide
  Target: ANGPTL3; (+) strand; PAM type: YTN; PAM sequence: CTT
taataataaatttacccaac

SEQ ID NO: 14526 - DNA, 20 bp, Artificial Sequence
  Description of Artificial Sequence: Synthetic oligonucleotide
  Target: ANGPTL3; (+) strand; PAM type: YTN; PAM sequence: TTT
aataataaatttacccaaca

SEQ ID NO: 14527 - DNA, 20 bp, Artificial Sequence
  Description of Artificial Sequence: Synthetic oligonucleotide
  Target: ANGPTL3; (+) strand; PAM type: YTN; PAM sequence: TTA
ataataaatttacccaacaa

SEQ ID NO: 14528 - DNA, 20 bp, Artificial Sequence
  Description of Artificial Sequence: Synthetic oligonucleotide
  Target: ANGPTL3; (+) strand; PAM type: YTN; PAM sequence: TTT
acccaacaaaaaagtttatt

SEQ ID NO: 14529 - DNA, 20 bp, Artificial Sequence
  Description of Artificial Sequence: Synthetic oligonucleotide
  Target: ANGPTL3; (+) strand; PAM type: YTN; PAM sequence: TTA
cccaacaaaaaagtttattt

SEQ ID NO: 14530 - DNA, 20 bp, Artificial Sequence
  Description of Artificial Sequence: Synthetic oligonucleotide
  Target: ANGPTL3; (+) strand; PAM type: YTN; PAM sequence: TTT
atttttgacttgtaaatctc

SEQ ID NO: 14531 - DNA, 20 bp, Artificial Sequence
  Description of Artificial Sequence: Synthetic oligonucleotide
  Target: ANGPTL3; (+) strand; PAM type: YTN; PAM sequence: TTA
tttttgacttgtaaatctct

SEQ ID NO: 14532 - DNA, 20 bp, Artificial Sequence
  Description of Artificial Sequence: Synthetic oligonucleotide
  Target: ANGPTL3; (+) strand; PAM type: YTN; PAM sequence: TTT
ttgacttgtaaatctcttaa

SEQ ID NO: 14533 - DNA, 20 bp, Artificial Sequence
  Description of Artificial Sequence: Synthetic oligonucleotide
  Target: ANGPTL3; (+) strand; PAM type: YTN; PAM sequence: TTT
tgacttgtaaatctcttaaa

SEQ ID NO: 14534 - DNA, 20 bp, Artificial Sequence
  Description of Artificial Sequence: Synthetic oligonucleotide
  Target: ANGPTL3; (+) strand; PAM type: YTN; PAM sequence: TTT
gacttgtaaatctcttaaaa

SEQ ID NO: 14535 - DNA, 20 bp, Artificial Sequence
  Description of Artificial Sequence: Synthetic oligonucleotide
  Target: ANGPTL3; (+) strand; PAM type: YTN; PAM sequence: TTG
acttgtaaatctcttaaaat

SEQ ID NO: 14536 - DNA, 20 bp, Artificial Sequence
  Description of Artificial Sequence: Synthetic oligonucleotide
  Target: ANGPTL3; (+) strand; PAM type: YTN; PAM sequence: CTT
gtaaatctcttaaaatcata

SEQ ID NO: 14537 - DNA, 20 bp, Artificial Sequence
  Description of Artificial Sequence: Synthetic oligonucleotide
  Target: ANGPTL3; (+) strand; PAM type: YTN; PAM sequence: TTG
taaatctcttaaaatcataa

SEQ ID NO: 14538 - DNA, 20 bp, Artificial Sequence
  Description of Artificial Sequence: Synthetic oligonucleotide
  Target: ANGPTL3; (+) strand; PAM type: YTN; PAM sequence: CTC
ttaaaatcataaaaaagtaa

SEQ ID NO: 14539 - DNA, 20 bp, Artificial Sequence
  Description of Artificial Sequence: Synthetic oligonucleotide
  Target: ANGPTL3; (+) strand; PAM type: YTN; PAM sequence: CTT
aaaatcataaaaaagtaaaa

SEQ ID NO: 14540 - DNA, 20 bp, Artificial Sequence
  Description of Artificial Sequence: Synthetic oligonucleotide
  Target: ANGPTL3; (+) strand; PAM type: YTN; PAM sequence: TTA
aaatcataaaaaagtaaaat

SEQ ID NO: 14541 - DNA, 20 bp, Artificial Sequence
  Description of Artificial Sequence: Synthetic oligonucleotide
  Target: ANGPTL3; (+) strand; PAM type: YTN; PAM sequence: TTA
gcttttaaaaacaggtagtc

SEQ ID NO: 14542 - DNA, 20 bp, Artificial Sequence
  Description of Artificial Sequence: Synthetic oligonucleotide
  Target: ANGPTL3; (+) strand; PAM type: YTN; PAM sequence: CTT
ttaaaaacaggtagtcacca

SEQ ID NO: 14543 - DNA, 20 bp, Artificial Sequence
  Description of Artificial Sequence: Synthetic oligonucleotide
  Target: ANGPTL3; (+) strand; PAM type: YTN; PAM sequence: TTT
taaaaacaggtagtcaccat

SEQ ID NO: 14544 - DNA, 20 bp, Artificial Sequence
  Description of Artificial Sequence: Synthetic oligonucleotide
  Target: ANGPTL3; (+) strand; PAM type: YTN; PAM sequence: TTT
aaaaacaggtagtcaccata

SEQ ID NO: 14545 - DNA, 20 bp, Artificial Sequence
  Description of Artificial Sequence: Synthetic oligonucleotide
  Target: ANGPTL3; (+) strand; PAM type: YTN; PAM sequence: TTA
aaaacaggtagtcaccatag

SEQ ID NO: 14546 - DNA, 20 bp, Artificial Sequence
  Description of Artificial Sequence: Synthetic oligonucleotide
  Target: ANGPTL3; (+) strand; PAM type: YTN; PAM sequence: TTG
aatgtgtagtttataataca

SEQ ID NO: 14547 - DNA, 20 bp, Artificial Sequence
  Description of Artificial Sequence: Synthetic oligonucleotide
  Target: ANGPTL3; (+) strand; PAM type: YTN; PAM sequence: TTT
ataatacagcaaagttaaat

SEQ ID NO: 14548 - DNA, 20 bp, Artificial Sequence
  Description of Artificial Sequence: Synthetic oligonucleotide
  Target: ANGPTL3; (+) strand; PAM type: YTN; PAM sequence: TTA
taatacagcaaagttaaata

SEQ ID NO: 14549 - DNA, 20 bp, Artificial Sequence
  Description of Artificial Sequence: Synthetic oligonucleotide
  Target: ANGPTL3; (+) strand; PAM type: YTN; PAM sequence: TTA
aatacaatttcaaattacct

SEQ ID NO: 14550 - DNA, 20 bp, Artificial Sequence
  Description of Artificial Sequence: Synthetic oligonucleotide
  Target: ANGPTL3; (+) strand; PAM type: YTN; PAM sequence: TTT
caaattacctattaagttag

SEQ ID NO: 14551 - DNA, 20 bp, Artificial Sequence
  Description of Artificial Sequence: Synthetic oligonucleotide
  Target: ANGPTL3; (+) strand; PAM type: YTN; PAM sequence: TTC
aaattacctattaagttagt

SEQ ID NO: 14552 - DNA, 20 bp, Artificial Sequence
  Description of Artificial Sequence: Synthetic oligonucleotide
  Target: ANGPTL3; (+) strand; PAM type: YTN; PAM sequence: TTA
cctattaagttagttgctca

SEQ ID NO: 14553 - DNA, 20 bp, Artificial Sequence
  Description of Artificial Sequence: Synthetic oligonucleotide
  Target: ANGPTL3; (+) strand; PAM type: YTN; PAM sequence: CTA
ttaagttagttgctcatttc

SEQ ID NO: 14554 - DNA, 20 bp, Artificial Sequence
  Description of Artificial Sequence: Synthetic oligonucleotide
  Target: ANGPTL3; (+) strand; PAM type: YTN; PAM sequence: TTA
agttagttgctcatttcttt

SEQ ID NO: 14555 - DNA, 20 bp, Artificial Sequence
  Description of Artificial Sequence: Synthetic oligonucleotide
  Target: ANGPTL3; (+) strand; PAM type: YTN; PAM sequence: TTA
gttgctcatttctttgattt

SEQ ID NO: 14556 - DNA, 20 bp, Artificial Sequence
  Description of Artificial Sequence: Synthetic oligonucleotide
  Target: ANGPTL3; (+) strand; PAM type: YTN; PAM sequence: TTG
ctcatttctttgatttcatt

SEQ ID NO: 14557 - DNA, 20 bp, Artificial Sequence
  Description of Artificial Sequence: Synthetic oligonucleotide
  Target: ANGPTL3; (+) strand; PAM type: YTN; PAM sequence: CTC
atttctttgatttcatttag

SEQ ID NO: 14558 - DNA, 20 bp, Artificial Sequence
  Description of Artificial Sequence: Synthetic oligonucleotide
  Target: ANGPTL3; (+) strand; PAM type: YTN; PAM sequence: TTT
ctttgatttcatttagcatt

SEQ ID NO: 14559 - DNA, 20 bp, Artificial Sequence
  Description of Artificial Sequence: Synthetic oligonucleotide
  Target: ANGPTL3; (+) strand; PAM type: YTN; PAM sequence: TTC
tttgatttcatttagcattg

SEQ ID NO: 14560 - DNA, 20 bp, Artificial Sequence
  Description of Artificial Sequence: Synthetic oligonucleotide
  Target: ANGPTL3; (+) strand; PAM type: YTN; PAM sequence: CTT
tgatttcatttagcattgat

SEQ ID NO: 14561 - DNA, 20 bp, Artificial Sequence
  Description of Artificial Sequence: Synthetic oligonucleotide
  Target: ANGPTL3; (+) strand; PAM type: YTN; PAM sequence: TTT
gatttcatttagcattgatc

SEQ ID NO: 14562 - DNA, 20 bp, Artificial Sequence
  Description of Artificial Sequence: Synthetic oligonucleotide
  Target: ANGPTL3; (+) strand; PAM type: YTN; PAM sequence: TTG
atttcatttagcattgatct

SEQ ID NO: 14563 - DNA, 20 bp, Artificial Sequence
  Description of Artificial Sequence: Synthetic oligonucleotide
  Target: ANGPTL3; (+) strand; PAM type: YTN; PAM sequence: TTT
catttagcattgatctaact

SEQ ID NO: 14564 - DNA, 20 bp, Artificial Sequence
  Description of Artificial Sequence: Synthetic oligonucleotide
  Target: ANGPTL3; (+) strand; PAM type: YTN; PAM sequence: TTC
atttagcattgatctaactc

SEQ ID NO: 14565 - DNA, 20 bp, Artificial Sequence
  Description of Artificial Sequence: Synthetic oligonucleotide
  Target: ANGPTL3; (+) strand; PAM type: YTN; PAM sequence: TTT
agcattgatctaactcaatg

SEQ ID NO: 14566 - DNA, 20 bp, Artificial Sequence
  Description of Artificial Sequence: Synthetic oligonucleotide
  Target: ANGPTL3; (+) strand; PAM type: YTN; PAM sequence: TTA
gcattgatctaactcaatgt

SEQ ID NO: 14567 - DNA, 20 bp, Artificial Sequence
  Description of Artificial Sequence: Synthetic oligonucleotide
  Target: ANGPTL3; (+) strand; PAM type: YTN; PAM sequence: TTG
atctaactcaatgtggaaga

SEQ ID NO: 14568 - DNA, 20 bp, Artificial Sequence
  Description of Artificial Sequence: Synthetic oligonucleotide
  Target: ANGPTL3; (+) strand; PAM type: YTN; PAM sequence: CTA
actcaatgtggaagaaggtt

SEQ ID NO: 14569 - DNA, 20 bp, Artificial Sequence
  Description of Artificial Sequence: Synthetic oligonucleotide
  Target: ANGPTL3; (+) strand; PAM type: YTN; PAM sequence: CTC
aatgtggaagaaggttacat

SEQ ID NO: 14570 - DNA, 20 bp, Artificial Sequence
  Description of Artificial Sequence: Synthetic oligonucleotide
  Target: ANGPTL3; (+) strand; PAM type: YTN; PAM sequence: TTA
cattcgtgcaagttaacacg

SEQ ID NO: 14571 - DNA, 20 bp, Artificial Sequence
  Description of Artificial Sequence: Synthetic oligonucleotide
  Target: ANGPTL3; (+) strand; PAM type: YTN; PAM sequence: TTC
gtgcaagttaacacggctta

SEQ ID NO: 14572 - DNA, 20 bp, Artificial Sequence
  Description of Artificial Sequence: Synthetic oligonucleotide
  Target: ANGPTL3; (+) strand; PAM type: YTN; PAM sequence: TTA
acacggcttaatgattaact

SEQ ID NO: 14573 - DNA, 20 bp, Artificial Sequence
  Description of Artificial Sequence: Synthetic oligonucleotide
  Target: ANGPTL3; (+) strand; PAM type: YTN; PAM sequence: CTT
aatgattaactatgttcacc

SEQ ID NO: 14574 - DNA, 20 bp, Artificial Sequence
  Description of Artificial Sequence: Synthetic oligonucleotide
  Target: ANGPTL3; (+) strand; PAM type: YTN; PAM sequence: TTA
atgattaactatgttcacct

SEQ ID NO: 14575 - DNA, 20 bp, Artificial Sequence
  Description of Artificial Sequence: Synthetic oligonucleotide
  Target: ANGPTL3; (+) strand; PAM type: YTN; PAM sequence: TTA
actatgttcacctaccaacc

SEQ ID NO: 14576 - DNA, 20 bp, Artificial Sequence
  Description of Artificial Sequence: Synthetic oligonucleotide
  Target: ANGPTL3; (+) strand; PAM type: YTN; PAM sequence: CTA
tgttcacctaccaaccttac

SEQ ID NO: 14577 - DNA, 20 bp, Artificial Sequence
  Description of Artificial Sequence: Synthetic oligonucleotide
  Target: ANGPTL3; (+) strand; PAM type: YTN; PAM sequence: TTC
acctaccaaccttacctttt

SEQ ID NO: 14578 - DNA, 20 bp, Artificial Sequence
  Description of Artificial Sequence: Synthetic oligonucleotide
  Target: ANGPTL3; (+) strand; PAM type: YTN; PAM sequence: CTA
ccaaccttaccttttctggg

SEQ ID NO: 14579 - DNA, 20 bp, Artificial Sequence
  Description of Artificial Sequence: Synthetic oligonucleotide
  Target: ANGPTL3; (+) strand; PAM type: YTN; PAM sequence: CTT
accttttctgggcaaatatt

SEQ ID NO: 14580 - DNA, 20 bp, Artificial Sequence
  Description of Artificial Sequence: Synthetic oligonucleotide
  Target: ANGPTL3; (+) strand; PAM type: YTN; PAM sequence: TTA
ccttttctgggcaaatattg

SEQ ID NO: 14581 - DNA, 20 bp, Artificial Sequence
  Description of Artificial Sequence: Synthetic oligonucleotide
  Target: ANGPTL3; (+) strand; PAM type: YTN; PAM sequence: CTT
ttctgggcaaatattggtat

SEQ ID NO: 14582 - DNA, 20 bp, Artificial Sequence
  Description of Artificial Sequence: Synthetic oligonucleotide
  Target: ANGPTL3; (+) strand; PAM type: YTN; PAM sequence: TTT
tctgggcaaatattggtata

SEQ ID NO: 14583 - DNA, 20 bp, Artificial Sequence
  Description of Artificial Sequence: Synthetic oligonucleotide
  Target: ANGPTL3; (+) strand; PAM type: YTN; PAM sequence: TTT
ctgggcaaatattggtatat

SEQ ID NO: 14584 - DNA, 20 bp, Artificial Sequence
  Description of Artificial Sequence: Synthetic oligonucleotide
  Target: ANGPTL3; (+) strand; PAM type: YTN; PAM sequence: TTC
tgggcaaatattggtatata

SEQ ID NO: 14585 - DNA, 20 bp, Artificial Sequence
  Description of Artificial Sequence: Synthetic oligonucleotide
  Target: ANGPTL3; (+) strand; PAM type: YTN; PAM sequence: CTG
ggcaaatattggtatatata

SEQ ID NO: 14586 - DNA, 20 bp, Artificial Sequence
  Description of Artificial Sequence: Synthetic oligonucleotide
  Target: ANGPTL3; (+) strand; PAM type: YTN; PAM sequence: TTG
gtatatatagagttaagaag

SEQ ID NO: 14587 - DNA, 20 bp, Artificial Sequence
  Description of Artificial Sequence: Synthetic oligonucleotide
  Target: ANGPTL3; (+) strand; PAM type: YTN; PAM sequence: TTA
agaagtctaggtctgcttcc

SEQ ID NO: 14588 - DNA, 20 bp, Artificial Sequence
  Description of Artificial Sequence: Synthetic oligonucleotide
  Target: ANGPTL3; (+) strand; PAM type: YTN; PAM sequence: CTA
ggtctgcttccagaagaaaa

SEQ ID NO: 14589 - DNA, 20 bp, Artificial Sequence
  Description of Artificial Sequence: Synthetic oligonucleotide
  Target: ANGPTL3; (+) strand; PAM type: YTN; PAM sequence: CTG
cttccagaagaaaacagttc

SEQ ID NO: 14590 - DNA, 20 bp, Artificial Sequence
  Description of Artificial Sequence: Synthetic oligonucleotide
  Target: ANGPTL3; (+) strand; PAM type: YTN; PAM sequence: CTT
ccagaagaaaacagttccac

SEQ ID NO: 14591 - DNA, 20 bp, Artificial Sequence
  Description of Artificial Sequence: Synthetic oligonucleotide
  Target: ANGPTL3; (+) strand; PAM type: YTN; PAM sequence: TTC
cagaagaaaacagttccacg

SEQ ID NO: 14592 - DNA, 20 bp, Artificial Sequence
  Description of Artificial Sequence: Synthetic oligonucleotide
  Target: ANGPTL3; (+) strand; PAM type: YTN; PAM sequence: TTC
cacgttgcttgaaattgaaa

SEQ ID NO: 14593 - DNA, 20 bp, Artificial Sequence
  Description of Artificial Sequence: Synthetic oligonucleotide
  Target: ANGPTL3; (+) strand; PAM type: YTN; PAM sequence: TTG
cttgaaattgaaaatcaaga

SEQ ID NO: 14594 - DNA, 20 bp, Artificial Sequence
  Description of Artificial Sequence: Synthetic oligonucleotide
  Target: ANGPTL3; (+) strand; PAM type: YTN; PAM sequence: CTT
gaaattgaaaatcaagataa

SEQ ID NO: 14595 - DNA, 20 bp, Artificial Sequence
  Description of Artificial Sequence: Synthetic oligonucleotide
  Target: ANGPTL3; (+) strand; PAM type: YTN; PAM sequence: TTG
aaattgaaaatcaagataaa

SEQ ID NO: 14596 - DNA, 20 bp, Artificial Sequence
  Description of Artificial Sequence: Synthetic oligonucleotide
  Target: ANGPTL3; (+) strand; PAM type: YTN; PAM sequence: TTG
aaaatcaagataaaaatgtt

SEQ ID NO: 14597 - DNA, 20 bp, Artificial Sequence
  Description of Artificial Sequence: Synthetic oligonucleotide
  Target: ANGPTL3; (+) strand; PAM type: YTN; PAM sequence: TTC
acaattaagctccttctttt

SEQ ID NO: 14598 - DNA, 20 bp, Artificial Sequence
  Description of Artificial Sequence: Synthetic oligonucleotide
  Target: ANGPTL3; (+) strand; PAM type: YTN; PAM sequence: TTA
agctccttctttttattgtt

SEQ ID NO: 14599 - DNA, 20 bp, Artificial Sequence
  Description of Artificial Sequence: Synthetic oligonucleotide
  Target: ANGPTL3; (+) strand; PAM type: YTN; PAM sequence: CTC
cttctttttattgttcctct

SEQ ID NO: 14600 - DNA, 20 bp, Artificial Sequence
  Description of Artificial Sequence: Synthetic oligonucleotide
  Target: ANGPTL3; (+) strand; PAM type: YTN; PAM sequence: CTT
ctttttattgttcctctagt

SEQ ID NO: 14601 - DNA, 20 bp, Artificial Sequence
  Description of Artificial Sequence: Synthetic oligonucleotide
  Target: ANGPTL3; (+) strand; PAM type: YTN; PAM sequence: TTC
tttttattgttcctctagtt

SEQ ID NO: 14602 - DNA, 20 bp, Artificial Sequence
  Description of Artificial Sequence: Synthetic oligonucleotide
  Target: ANGPTL3; (+) strand; PAM type: YTN; PAM sequence: CTT
tttattgttcctctagttat

SEQ ID NO: 14603 - DNA, 20 bp, Artificial Sequence
  Description of Artificial Sequence: Synthetic oligonucleotide
  Target: ANGPTL3; (+) strand; PAM type: YTN; PAM sequence: TTT
ttattgttcctctagttatt

SEQ ID NO: 14604 - DNA, 20 bp, Artificial Sequence
  Description of Artificial Sequence: Synthetic oligonucleotide
  Target: ANGPTL3; (+) strand; PAM type: YTN; PAM sequence: TTT
tattgttcctctagttattt

SEQ ID NO: 14605 - DNA, 20 bp, Artificial Sequence
  Description of Artificial Sequence: Synthetic oligonucleotide
  Target: ANGPTL3; (+) strand; PAM type: YTN; PAM sequence: TTT
attgttcctctagttatttc

SEQ ID NO: 14606 - DNA, 20 bp, Artificial Sequence
  Description of Artificial Sequence: Synthetic oligonucleotide
  Target: ANGPTL3; (+) strand; PAM type: YTN; PAM sequence: TTA
ttgttcctctagttatttcc

SEQ ID NO: 14607 - DNA, 20 bp, Artificial Sequence
  Description of Artificial Sequence: Synthetic oligonucleotide
  Target: ANGPTL3; (+) strand; PAM type: YTN; PAM sequence: TTG
ttcctctagttatttcctcc

SEQ ID NO: 14608 - DNA, 20 bp, Artificial Sequence
  Description of Artificial Sequence: Synthetic oligonucleotide
  Target: ANGPTL3; (+) strand; PAM type: YTN; PAM sequence: TTC
ctctagttatttcctccaga

SEQ ID NO: 14609 - DNA, 20 bp, Artificial Sequence
  Description of Artificial Sequence: Synthetic oligonucleotide
  Target: ANGPTL3; (+) strand; PAM type: YTN; PAM sequence: CTC
tagttatttcctccagaatt

SEQ ID NO: 14610 - DNA, 20 bp, Artificial Sequence
  Description of Artificial Sequence: Synthetic oligonucleotide
  Target: ANGPTL3; (+) strand; PAM type: YTN; PAM sequence: CTA
gttatttcctccagaattga

SEQ ID NO: 14611 - DNA, 20 bp, Artificial Sequence
  Description of Artificial Sequence: Synthetic oligonucleotide
  Target: ANGPTL3; (+) strand; PAM type: YTN; PAM sequence: TTA
tttcctccagaattgatcaa

SEQ ID NO: 14612 - DNA, 20 bp, Artificial Sequence
  Description of Artificial Sequence: Synthetic oligonucleotide
  Target: ANGPTL3; (+) strand; PAM type: YTN; PAM sequence: TTT
cctccagaattgatcaagac

SEQ ID NO: 14613 - DNA, 20 bp, Artificial Sequence
  Description of Artificial Sequence: Synthetic oligonucleotide
  Target: ANGPTL3; (+) strand; PAM type: YTN; PAM sequence: TTC
ctccagaattgatcaagaca

SEQ ID NO: 14614 - DNA, 20 bp, Artificial Sequence
  Description of Artificial Sequence: Synthetic oligonucleotide
  Target: ANGPTL3; (+) strand; PAM type: YTN; PAM sequence: CTC
cagaattgatcaagacaatt

SEQ ID NO: 14615 - DNA, 20 bp, Artificial Sequence
  Description of Artificial Sequence: Synthetic oligonucleotide
  Target: ANGPTL3; (+) strand; PAM type: YTN; PAM sequence: TTG
atcaagacaattcatcattt

SEQ ID NO: 14616 - DNA, 20 bp, Artificial Sequence
  Description of Artificial Sequence: Synthetic oligonucleotide
  Target: ANGPTL3; (+) strand; PAM type: YTN; PAM sequence: TTC
atcatttgattctctatctc

SEQ ID NO: 14617 - DNA, 20 bp, Artificial Sequence
  Description of Artificial Sequence: Synthetic oligonucleotide
  Target: ANGPTL3; (+) strand; PAM type: YTN; PAM sequence: TTT
gattctctatctccagagcc

SEQ ID NO: 14618 - DNA, 20 bp, Artificial Sequence
  Description of Artificial Sequence: Synthetic oligonucleotide
  Target: ANGPTL3; (+) strand; PAM type: YTN; PAM sequence: TTG
attctctatctccagagcca

SEQ ID NO: 14619 - DNA, 20 bp, Artificial Sequence
  Description of Artificial Sequence: Synthetic oligonucleotide
  Target: ANGPTL3; (+) strand; PAM type: YTN; PAM sequence: TTC
tctatctccagagccaaaat

SEQ ID NO: 14620 - DNA, 20 bp, Artificial Sequence
  Description of Artificial Sequence: Synthetic oligonucleotide
  Target: ANGPTL3; (+) strand; PAM type: YTN; PAM sequence: CTC
tatctccagagccaaaatca

SEQ ID NO: 14621 - DNA, 20 bp, Artificial Sequence
  Description of Artificial Sequence: Synthetic oligonucleotide
  Target: ANGPTL3; (+) strand; PAM type: YTN; PAM sequence: CTA
tctccagagccaaaatcaag

SEQ ID NO: 14622 - DNA, 20 bp, Artificial Sequence
  Description of Artificial Sequence: Synthetic oligonucleotide
  Target: ANGPTL3; (+) strand; PAM type: YTN; PAM sequence: CTC
cagagccaaaatcaagattt

SEQ ID NO: 14623 - DNA, 20 bp, Artificial Sequence
  Description of Artificial Sequence: Synthetic oligonucleotide
  Target: ANGPTL3; (+) strand; PAM type: YTN; PAM sequence: TTT
gctatgttagacgatgtaaa

SEQ ID NO: 14624 - DNA, 20 bp, Artificial Sequence
  Description of Artificial Sequence: Synthetic oligonucleotide
  Target: ANGPTL3; (+) strand; PAM type: YTN; PAM sequence: TTG
ctatgttagacgatgtaaaa

SEQ ID NO: 14625 - DNA, 20 bp, Artificial Sequence
  Description of Artificial Sequence: Synthetic oligonucleotide
  Target: ANGPTL3; (+) strand; PAM type: YTN; PAM sequence: CTA
tgttagacgatgtaaaaatt

SEQ ID NO: 14626 - DNA, 20 bp, Artificial Sequence
  Description of Artificial Sequence: Synthetic oligonucleotide
  Target: ANGPTL3; (+) strand; PAM type: YTN; PAM sequence: TTA
gacgatgtaaaaattttagc

SEQ ID NO: 14627 - DNA, 20 bp, Artificial Sequence
  Description of Artificial Sequence: Synthetic oligonucleotide
  Target: ANGPTL3; (+) strand; PAM type: YTN; PAM sequence: TTT
tagccaatggcctccttcag

SEQ ID NO: 14628 - DNA, 20 bp, Artificial Sequence
  Description of Artificial Sequence: Synthetic oligonucleotide
  Target: ANGPTL3; (+) strand; PAM type: YTN; PAM sequence: TTT
agccaatggcctccttcagt

SEQ ID NO: 14629 - DNA, 20 bp, Artificial Sequence
  Description of Artificial Sequence: Synthetic oligonucleotide
  Target: ANGPTL3; (+) strand; PAM type: YTN; PAM sequence: TTA
gccaatggcctccttcagtt

SEQ ID NO: 14630 - DNA, 20 bp, Artificial Sequence
  Description of Artificial Sequence: Synthetic oligonucleotide
  Target: ANGPTL3; (+) strand; PAM type: YTN; PAM sequence: CTC
cttcagttgggacatggtct

SEQ ID NO: 14631 - DNA, 20 bp, Artificial Sequence
  Description of Artificial Sequence: Synthetic oligonucleotide
  Target: ANGPTL3; (+) strand; PAM type: YTN; PAM sequence: CTT
cagttgggacatggtcttaa

SEQ ID NO: 14632 - DNA, 20 bp, Artificial Sequence
  Description of Artificial Sequence: Synthetic oligonucleotide
  Target: ANGPTL3; (+) strand; PAM type: YTN; PAM sequence: TTC
agttgggacatggtcttaaa

SEQ ID NO: 14633 - DNA, 20 bp, Artificial Sequence
  Description of Artificial Sequence: Synthetic oligonucleotide
  Target: ANGPTL3; (+) strand; PAM type: YTN; PAM sequence: TTG
ggacatggtcttaaagactt

SEQ ID NO: 14634 - DNA, 20 bp, Artificial Sequence
  Description of Artificial Sequence: Synthetic oligonucleotide
  Target: ANGPTL3; (+) strand; PAM type: YTN; PAM sequence: CTT
aaagactttgtccataagac

SEQ ID NO: 14635 - DNA, 20 bp, Artificial Sequence
  Description of Artificial Sequence: Synthetic oligonucleotide
  Target: ANGPTL3; (+) strand; PAM type: YTN; PAM sequence: TTA
aagactttgtccataagacg

SEQ ID NO: 14636 - DNA, 20 bp, Artificial Sequence
  Description of Artificial Sequence: Synthetic oligonucleotide
  Target: ANGPTL3; (+) strand; PAM type: YTN; PAM sequence: CTT
tgtccataagacgaagggcc

SEQ ID NO: 14637 - DNA, 20 bp, Artificial Sequence
  Description of Artificial Sequence: Synthetic oligonucleotide
  Target: ANGPTL3; (+) strand; PAM type: YTN; PAM sequence: TTT
gtccataagacgaagggcca

SEQ ID NO: 14638 - DNA, 20 bp, Artificial Sequence
  Description of Artificial Sequence: Synthetic oligonucleotide
  Target: ANGPTL3; (+) strand; PAM type: YTN; PAM sequence: TTG
tccataagacgaagggccaa

SEQ ID NO: 14639 - DNA, 20 bp, Artificial Sequence
  Description of Artificial Sequence: Synthetic oligonucleotide
  Target: ANGPTL3; (+) strand; PAM type: YTN; PAM sequence: TTA
atgacatatttcaaaaactc

SEQ ID NO: 14640 - DNA, 20 bp, Artificial Sequence
  Description of Artificial Sequence: Synthetic oligonucleotide
  Target: ANGPTL3; (+) strand; PAM type: YTN; PAM sequence: TTT
caaaaactcaacatatttga

SEQ ID NO: 14641 - DNA, 20 bp, Artificial Sequence
  Description of Artificial Sequence: Synthetic oligonucleotide
  Target: ANGPTL3; (+) strand; PAM type: YTN; PAM sequence: TTC
aaaaactcaacatatttgat

SEQ ID NO: 14642 - DNA, 20 bp, Artificial Sequence
  Description of Artificial Sequence: Synthetic oligonucleotide
  Target: ANGPTL3; (+) strand; PAM type: YTN; PAM sequence: CTC
aacatatttgatcagtcttt

SEQ ID NO: 14643 - DNA, 20 bp, Artificial Sequence
  Description of Artificial Sequence: Synthetic oligonucleotide
  Target: ANGPTL3; (+) strand; PAM type: YTN; PAM sequence: TTT
gatcagtctttttatgatct

SEQ ID NO: 14644 - DNA, 20 bp, Artificial Sequence
  Description of Artificial Sequence: Synthetic oligonucleotide
  Target: ANGPTL3; (+) strand; PAM type: YTN; PAM sequence: TTG
atcagtctttttatgatcta

SEQ ID NO: 14645 - DNA, 20 bp, Artificial Sequence
  Description of Artificial Sequence: Synthetic oligonucleotide
  Target: ANGPTL3; (+) strand; PAM type: YTN; PAM sequence: CTT
tttatgatctatcgctgcaa

SEQ ID NO: 14646 - DNA, 20 bp, Artificial Sequence
  Description of Artificial Sequence: Synthetic oligonucleotide
  Target: ANGPTL3; (+) strand; PAM type: YTN; PAM sequence: TTT
ttatgatctatcgctgcaaa

SEQ ID NO: 14647 - DNA, 20 bp, Artificial Sequence
  Description of Artificial Sequence: Synthetic oligonucleotide
  Target: ANGPTL3; (+) strand; PAM type: YTN; PAM sequence: TTT
tatgatctatcgctgcaaac

SEQ ID NO: 14648 - DNA, 20 bp, Artificial Sequence
  Description of Artificial Sequence: Synthetic oligonucleotide
  Target: ANGPTL3; (+) strand; PAM type: YTN; PAM sequence: TTT
atgatctatcgctgcaaacc

SEQ ID NO: 14649 - DNA, 20 bp, Artificial Sequence
  Description of Artificial Sequence: Synthetic oligonucleotide
  Target: ANGPTL3; (+) strand; PAM type: YTN; PAM sequence: TTA
tgatctatcgctgcaaacca

SEQ ID NO: 14650 - DNA, 20 bp, Artificial Sequence
  Description of Artificial Sequence: Synthetic oligonucleotide
  Target: ANGPTL3; (+) strand; PAM type: YTN; PAM sequence: CTA
tcgctgcaaaccagtgaaat

SEQ ID NO: 14651 - DNA, 20 bp, Artificial Sequence
  Description of Artificial Sequence: Synthetic oligonucleotide
  Target: ANGPTL3; (+) strand; PAM type: YTN; PAM sequence: CTG
caaaccagtgaaatcaaaga

SEQ ID NO: 14652 - DNA, 20 bp, Artificial Sequence
  Description of Artificial Sequence: Synthetic oligonucleotide
  Target: ANGPTL3; (+) strand; PAM type: YTN; PAM sequence: CTG
agaagaactacatataaact

SEQ ID NO: 14653 - DNA, 20 bp, Artificial Sequence
  Description of Artificial Sequence: Synthetic oligonucleotide
  Target: ANGPTL3; (+) strand; PAM type: YTN; PAM sequence: CTA
catataaactacaagtcaaa

SEQ ID NO: 14654 - DNA, 20 bp, Artificial Sequence
  Description of Artificial Sequence: Synthetic oligonucleotide
  Target: ANGPTL3; (+) strand; PAM type: YTN; PAM sequence: CTA
caagtcaaaaatgaagaggt

SEQ ID NO: 14655 - DNA, 20 bp, Artificial Sequence
  Description of Artificial Sequence: Synthetic oligonucleotide
  Target: ANGPTL3; (+) strand; PAM type: YTN; PAM sequence: CTT
gaactcaactcaaaacttga

SEQ ID NO: 14656 - DNA, 20 bp, Artificial Sequence
  Description of Artificial Sequence: Synthetic oligonucleotide
  Target: ANGPTL3; (+) strand; PAM type: YTN; PAM sequence: TTG
aactcaactcaaaacttgaa

SEQ ID NO: 14657 - DNA, 20 bp, Artificial Sequence
  Description of Artificial Sequence: Synthetic oligonucleotide
  Target: ANGPTL3; (+) strand; PAM type: YTN; PAM sequence: CTC
aactcaaaacttgaaagcct

SEQ ID NO: 14658 - DNA, 20 bp, Artificial Sequence
  Description of Artificial Sequence: Synthetic oligonucleotide
  Target: ANGPTL3; (+) strand; PAM type: YTN; PAM sequence: CTC
aaaacttgaaagcctcctag

SEQ ID NO: 14659 - DNA, 20 bp, Artificial Sequence
  Description of Artificial Sequence: Synthetic oligonucleotide
  Target: ANGPTL3; (+) strand; PAM type: YTN; PAM sequence: CTT
gaaagcctcctagaagaaaa

SEQ ID NO: 14660 - DNA, 20 bp, Artificial Sequence
  Description of Artificial Sequence: Synthetic oligonucleotide
  Target: ANGPTL3; (+) strand; PAM type: YTN; PAM sequence: TTG
aaagcctcctagaagaaaaa

SEQ ID NO: 14661 - DNA, 20 bp, Artificial Sequence
  Description of Artificial Sequence: Synthetic oligonucleotide
  Target: ANGPTL3; (+) strand; PAM type: YTN; PAM sequence: CTC
ctagaagaaaaaattctact

SEQ ID NO: 14662 - DNA, 20 bp, Artificial Sequence
  Description of Artificial Sequence: Synthetic oligonucleotide
  Target: ANGPTL3; (+) strand; PAM type: YTN; PAM sequence: CTA
gaagaaaaaattctacttca

SEQ ID NO: 14663 - DNA, 20 bp, Artificial Sequence
  Description of Artificial Sequence: Synthetic oligonucleotide
  Target: ANGPTL3; (+) strand; PAM type: YTN; PAM sequence: TTC
tacttcaacaaaaagtgaaa

SEQ ID NO: 14664 - DNA, 20 bp, Artificial Sequence
  Description of Artificial Sequence: Synthetic oligonucleotide
  Target: ANGPTL3; (+) strand; PAM type: YTN; PAM sequence: CTA
cttcaacaaaaagtgaaata

SEQ ID NO: 14665 - DNA, 20 bp, Artificial Sequence
  Description of Artificial Sequence: Synthetic oligonucleotide
  Target: ANGPTL3; (+) strand; PAM type: YTN; PAM sequence: CTT
caacaaaaagtgaaatattt

SEQ ID NO: 14666 - DNA, 20 bp, Artificial Sequence
  Description of Artificial Sequence: Synthetic oligonucleotide
  Target: ANGPTL3; (+) strand; PAM type: YTN; PAM sequence: TTC
aacaaaaagtgaaatattta

SEQ ID NO: 14667 - DNA, 20 bp, Artificial Sequence
  Description of Artificial Sequence: Synthetic oligonucleotide
  Target: ANGPTL3; (+) strand; PAM type: YTN; PAM sequence: TTT
agaagagcaactaactaact

SEQ ID NO: 14668 - DNA, 20 bp, Artificial Sequence
  Description of Artificial Sequence: Synthetic oligonucleotide
  Target: ANGPTL3; (+) strand; PAM type: YTN; PAM sequence: TTA
gaagagcaactaactaactt

SEQ ID NO: 14669 - DNA, 20 bp, Artificial Sequence
  Description of Artificial Sequence: Synthetic oligonucleotide
  Target: ANGPTL3; (+) strand; PAM type: YTN; PAM sequence: CTA
actaacttaattcaaaatca

SEQ ID NO: 14670 - DNA, 20 bp, Artificial Sequence
  Description of Artificial Sequence: Synthetic oligonucleotide
  Target: ANGPTL3; (+) strand; PAM type: YTN; PAM sequence: CTA
acttaattcaaaatcaacct

SEQ ID NO: 14671 - DNA, 20 bp, Artificial Sequence
  Description of Artificial Sequence: Synthetic oligonucleotide
  Target: ANGPTL3; (+) strand; PAM type: YTN; PAM sequence: CTT
aattcaaaatcaacctgaaa

SEQ ID NO: 14672 - DNA, 20 bp, Artificial Sequence
  Description of Artificial Sequence: Synthetic oligonucleotide
  Target: ANGPTL3; (+) strand; PAM type: YTN; PAM sequence: TTA
attcaaaatcaacctgaaac

SEQ ID NO: 14673 - DNA, 20 bp, Artificial Sequence
  Description of Artificial Sequence: Synthetic oligonucleotide
  Target: ANGPTL3; (+) strand; PAM type: YTN; PAM sequence: TTC
aaaatcaacctgaaactcca

SEQ ID NO: 14674 - DNA, 20 bp, Artificial Sequence
  Description of Artificial Sequence: Synthetic oligonucleotide
  Target: ANGPTL3; (+) strand; PAM type: YTN; PAM sequence: CTG
aaactccagaacacccagaa

SEQ ID NO: 14675 - DNA, 20 bp, Artificial Sequence
  Description of Artificial Sequence: Synthetic oligonucleotide
  Target: ANGPTL3; (+) strand; PAM type: YTN; PAM sequence: CTC
cagaacacccagaagtaact

SEQ ID NO: 14676 - DNA, 20 bp, Artificial Sequence
  Description of Artificial Sequence: Synthetic oligonucleotide
  Target: ANGPTL3; (+) strand; PAM type: YTN; PAM sequence: CTT
cacttaaagtaagtagaaaa

SEQ ID NO: 14677 - DNA, 20 bp, Artificial Sequence
  Description of Artificial Sequence: Synthetic oligonucleotide
  Target: ANGPTL3; (+) strand; PAM type: YTN; PAM sequence: TTC
acttaaagtaagtagaaaat

SEQ ID NO: 14678 - DNA, 20 bp, Artificial Sequence
  Description of Artificial Sequence: Synthetic oligonucleotide
  Target: ANGPTL3; (+) strand; PAM type: YTN; PAM sequence: CTT
aaagtaagtagaaaataaag

SEQ ID NO: 14679 - DNA, 20 bp, Artificial Sequence
  Description of Artificial Sequence: Synthetic oligonucleotide
  Target: ANGPTL3; (+) strand; PAM type: YTN; PAM sequence: TTA
aagtaagtagaaaataaaga

SEQ ID NO: 14680 - DNA, 20 bp, Artificial Sequence
  Description of Artificial Sequence: Synthetic oligonucleotide
  Target: ANGPTL3; (+) strand; PAM type: YTN; PAM sequence: TTC
atgtttatgttttcaatgtg

SEQ ID NO: 14681 - DNA, 20 bp, Artificial Sequence
  Description of Artificial Sequence: Synthetic oligonucleotide
  Target: ANGPTL3; (+) strand; PAM type: YTN; PAM sequence: TTT
atgttttcaatgtggatctt

SEQ ID NO: 14682 - DNA, 20 bp, Artificial Sequence
  Description of Artificial Sequence: Synthetic oligonucleotide
  Target: ANGPTL3; (+) strand; PAM type: YTN; PAM sequence: TTA
tgttttcaatgtggatcttt

SEQ ID NO: 14683 - DNA, 20 bp, Artificial Sequence
  Description of Artificial Sequence: Synthetic oligonucleotide
  Target: ANGPTL3; (+) strand; PAM type: YTN; PAM sequence: TTT
tcaatgtggatcttttaaaa

SEQ ID NO: 14684 - DNA, 20 bp, Artificial Sequence
  Description of Artificial Sequence: Synthetic oligonucleotide
  Target: ANGPTL3; (+) strand; PAM type: YTN; PAM sequence: TTT
caatgtggatcttttaaaaa

SEQ ID NO: 14685 - DNA, 20 bp, Artificial Sequence
  Description of Artificial Sequence: Synthetic oligonucleotide
  Target: ANGPTL3; (+) strand; PAM type: YTN; PAM sequence: TTC
aatgtggatcttttaaaaaa

SEQ ID NO: 14686 - DNA, 20 bp, Artificial Sequence
  Description of Artificial Sequence: Synthetic oligonucleotide
  Target: ANGPTL3; (+) strand; PAM type: YTN; PAM sequence: CTT
ttaaaaaaaatatttctaag

SEQ ID NO: 14687 - DNA, 20 bp, Artificial Sequence
  Description of Artificial Sequence: Synthetic oligonucleotide
  Target: ANGPTL3; (+) strand; PAM type: YTN; PAM sequence: TTT
taaaaaaaatatttctaagg

SEQ ID NO: 14688 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaaaatatttctaaggc

SEQ ID NO: 14689 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaaatatttctaaggca

SEQ ID NO: 14690 - DNA, 20 bp, Artificial Sequence
  Description of Artificial Sequence: Synthetic oligonucleotide
  Target: ANGPTL3; (+) strand; PAM type: YTN; PAM sequence: TTT
ctaaggcatgccatttgaaa

SEQ ID NO: 14691 - DNA, 20 bp, Artificial Sequence
  Description of Artificial Sequence: Synthetic oligonucleotide
  Target: ANGPTL3; (+) strand; PAM type: YTN; PAM sequence: TTC
taaggcatgccatttgaaat

SEQ ID NO: 14692 - DNA, 20 bp, Artificial Sequence
  Description of Artificial Sequence: Synthetic oligonucleotide
  Target: ANGPTL3; (+) strand; PAM type: YTN; PAM sequence: CTA
aggcatgccatttgaaatac

SEQ ID NO: 14693 - DNA, 20 bp, Artificial Sequence
  Description of Artificial Sequence: Synthetic oligonucleotide
  Target: ANGPTL3; (+) strand; PAM type: YTN; PAM sequence: TTT
gaaatactttgttgcattgt

SEQ ID NO: 14694 - DNA, 20 bp, Artificial Sequence
  Description of Artificial Sequence: Synthetic oligonucleotide
  Target: ANGPTL3; (+) strand; PAM type: YTN; PAM sequence: TTG
aaatactttgttgcattgtt

SEQ ID NO: 14695 - DNA, 20 bp, Artificial Sequence
  Description of Artificial Sequence: Synthetic oligonucleotide
  Target: ANGPTL3; (+) strand; PAM type: YTN; PAM sequence: CTT
tgttgcattgttgaaatact

SEQ ID NO: 14696 - DNA, 20 bp, Artificial Sequence
  Description of Artificial Sequence: Synthetic oligonucleotide
  Target: ANGPTL3; (+) strand; PAM type: YTN; PAM sequence: TTT
gttgcattgttgaaatactt

SEQ ID NO: 14697 - DNA, 20 bp, Artificial Sequence
  Description of Artificial Sequence: Synthetic oligonucleotide
  Target: ANGPTL3; (+) strand; PAM type: YTN; PAM sequence: TTG
ttgcattgttgaaatacttt

SEQ ID NO: 14698 - DNA, 20 bp, Artificial Sequence
  Description of Artificial Sequence: Synthetic oligonucleotide
  Target: ANGPTL3; (+) strand; PAM type: YTN; PAM sequence: TTG
cattgttgaaatactttttt

SEQ ID NO: 14699 - DNA, 20 bp, Artificial Sequence
  Description of Artificial Sequence: Synthetic oligonucleotide
  Target: ANGPTL3; (+) strand; PAM type: YTN; PAM sequence: TTG
ttgaaatacttttttttcca

SEQ ID NO: 14700 - DNA, 20 bp, Artificial Sequence
  Description of Artificial Sequence: Synthetic oligonucleotide
  Target: ANGPTL3; (+) strand; PAM type: YTN; PAM sequence: TTG
aaatacttttttttccaaga

SEQ ID NO: 14701 - DNA, 20 bp, Artificial Sequence
  Description of Artificial Sequence: Synthetic oligonucleotide
  Target: ANGPTL3; (+) strand; PAM type: YTN; PAM sequence: CTT
ttttttccaagaaaaataat

SEQ ID NO: 14702 - DNA, 20 bp, Artificial Sequence
  Description of Artificial Sequence: Synthetic oligonucleotide
  Target: ANGPTL3; (+) strand; PAM type: YTN; PAM sequence: TTT
tttttccaagaaaaataatc

SEQ ID NO: 14703 - DNA, 20 bp, Artificial Sequence
  Description of Artificial Sequence: Synthetic oligonucleotide
  Target: ANGPTL3; (+) strand; PAM type: YTN; PAM sequence: TTT
ttttccaagaaaaataatct

SEQ ID NO: 14704 - DNA, 20 bp, Artificial Sequence
  Description of Artificial Sequence: Synthetic oligonucleotide
  Target: ANGPTL3; (+) strand; PAM type: YTN; PAM sequence: TTT
tttccaagaaaaataatctc

SEQ ID NO: 14705 - DNA, 20 bp, Artificial Sequence
  Description of Artificial Sequence: Synthetic oligonucleotide
  Target: ANGPTL3; (+) strand; PAM type: YTN; PAM sequence: TTT
ttccaagaaaaataatctcc

SEQ ID NO: 14706 - DNA, 20 bp, Artificial Sequence
  Description of Artificial Sequence: Synthetic oligonucleotide
  Target: ANGPTL3; (+) strand; PAM type: YTN; PAM sequence: TTT
tccaagaaaaataatctcca

SEQ ID NO: 14707 - DNA, 20 bp, Artificial Sequence
  Description of Artificial Sequence: Synthetic oligonucleotide
  Target: ANGPTL3; (+) strand; PAM type: YTN; PAM sequence: TTT
ccaagaaaaataatctccag

SEQ ID NO: 14708 - DNA, 20 bp, Artificial Sequence
  Description of Artificial Sequence: Synthetic oligonucleotide
  Target: ANGPTL3; (+) strand; PAM type: YTN; PAM sequence: TTC
caagaaaaataatctccaga

SEQ ID NO: 14709 - DNA, 20 bp, Artificial Sequence
  Description of Artificial Sequence: Synthetic oligonucleotide
  Target: ANGPTL3; (+) strand; PAM type: YTN; PAM sequence: CTC
cagaaaataaaatttcctat

SEQ ID NO: 14710 - DNA, 20 bp, Artificial Sequence
  Description of Artificial Sequence: Synthetic oligonucleotide
  Target: ANGPTL3; (+) strand; PAM type: YTN; PAM sequence: TTT
cctattataatttcaagtta

SEQ ID NO: 14711 - DNA, 20 bp, Artificial Sequence
  Description of Artificial Sequence: Synthetic oligonucleotide
  Target: ANGPTL3; (+) strand; PAM type: YTN; PAM sequence: TTC
ctattataatttcaagttag

SEQ ID NO: 14712 - DNA, 20 bp, Artificial Sequence
  Description of Artificial Sequence: Synthetic oligonucleotide
  Target: ANGPTL3; (+) strand; PAM type: YTN; PAM sequence: CTA
ttataatttcaagttagttt

SEQ ID NO: 14713 - DNA, 20 bp, Artificial Sequence
  Description of Artificial Sequence: Synthetic oligonucleotide
  Target: ANGPTL3; (+) strand; PAM type: YTN; PAM sequence: TTA
taatttcaagttagtttttt

SEQ ID NO: 14714 - DNA, 20 bp, Artificial Sequence
  Description of Artificial Sequence: Synthetic oligonucleotide
  Target: ANGPTL3; (+) strand; PAM type: YTN; PAM sequence: TTT
caagttagttttttgtttcc

SEQ ID NO: 14715 - DNA, 20 bp, Artificial Sequence
  Description of Artificial Sequence: Synthetic oligonucleotide
  Target: ANGPTL3; (+) strand; PAM type: YTN; PAM sequence: TTC
aagttagttttttgtttccc

SEQ ID NO: 14716 - DNA, 20 bp, Artificial Sequence
  Description of Artificial Sequence: Synthetic oligonucleotide
  Target: ANGPTL3; (+) strand; PAM type: YTN; PAM sequence: TTA
gttttttgtttccctaatgt

SEQ ID NO: 14717 - DNA, 20 bp, Artificial Sequence
  Description of Artificial Sequence: Synthetic oligonucleotide
  Target: ANGPTL3; (+) strand; PAM type: YTN; PAM sequence: TTT
tttgtttccctaatgttata

SEQ ID NO: 14718 - DNA, 20 bp, Artificial Sequence
  Description of Artificial Sequence: Synthetic oligonucleotide
  Target: ANGPTL3; (+) strand; PAM type: YTN; PAM sequence: TTT
ttgtttccctaatgttatat

SEQ ID NO: 14719 - DNA, 20 bp, Artificial Sequence
  Description of Artificial Sequence: Synthetic oligonucleotide
  Target: ANGPTL3; (+) strand; PAM type: YTN; PAM sequence: TTT
tgtttccctaatgttatata

SEQ ID NO: 14720 - DNA, 20 bp, Artificial Sequence
  Description of Artificial Sequence: Synthetic oligonucleotide
  Target: ANGPTL3; (+) strand; PAM type: YTN; PAM sequence: TTT
gtttccctaatgttatatat

SEQ ID NO: 14721 - DNA, 20 bp, Artificial Sequence
  Description of Artificial Sequence: Synthetic oligonucleotide
  Target: ANGPTL3; (+) strand; PAM type: YTN; PAM sequence: TTG
tttccctaatgttatatatg

SEQ ID NO: 14722 - DNA, 20 bp, Artificial Sequence
  Description of Artificial Sequence: Synthetic oligonucleotide
  Target: ANGPTL3; (+) strand; PAM type: YTN; PAM sequence: TTT
ccctaatgttatatatgaaa

SEQ ID NO: 14723 - DNA, 20 bp, Artificial Sequence
  Description of Artificial Sequence: Synthetic oligonucleotide
  Target: ANGPTL3; (+) strand; PAM type: YTN; PAM sequence: TTC
cctaatgttatatatgaaaa

SEQ ID NO: 14724 - DNA, 20 bp, Artificial Sequence
  Description of Artificial Sequence: Synthetic oligonucleotide
  Target: ANGPTL3; (+) strand; PAM type: YTN; PAM sequence: CTA
atgttatatatgaaaacact

SEQ ID NO: 14725 - DNA, 20 bp, Artificial Sequence
  Description of Artificial Sequence: Synthetic oligonucleotide
  Target: ANGPTL3; (+) strand; PAM type: YTN; PAM sequence: TTA
tatatgaaaacactgaaaat

SEQ ID NO: 14726 - DNA, 20 bp, Artificial Sequence
  Description of Artificial Sequence: Synthetic oligonucleotide
  Target: ANGPTL3; (+) strand; PAM type: YTN; PAM sequence: CTG
aaaatttgcattttatatga

SEQ ID NO: 14727 - DNA, 20 bp, Artificial Sequence
  Description of Artificial Sequence: Synthetic oligonucleotide
  Target: ANGPTL3; (+) strand; PAM type: YTN; PAM sequence: TTT
gcattttatatgaaaattac

SEQ ID NO: 14728 - DNA, 20 bp, Artificial Sequence
  Description of Artificial Sequence: Synthetic oligonucleotide
  Target: ANGPTL3; (+) strand; PAM type: YTN; PAM sequence: TTG
cattttatatgaaaattaca

SEQ ID NO: 14729 - DNA, 20 bp, Artificial Sequence
  Description of Artificial Sequence: Synthetic oligonucleotide
  Target: ANGPTL3; (+) strand; PAM type: YTN; PAM sequence: TTT
tatatgaaaattacaaatcg

SEQ ID NO: 14730 - DNA, 20 bp, Artificial Sequence
  Description of Artificial Sequence: Synthetic oligonucleotide
  Target: ANGPTL3; (+) strand; PAM type: YTN; PAM sequence: TTT
atatgaaaattacaaatcgg

SEQ ID NO: 14731 - DNA, 20 bp, Artificial Sequence
  Description of Artificial Sequence: Synthetic oligonucleotide
  Target: ANGPTL3; (+) strand; PAM type: YTN; PAM sequence: TTA
tatgaaaattacaaatcggt

SEQ ID NO: 14732 - DNA, 20 bp, Artificial Sequence
  Description of Artificial Sequence: Synthetic oligonucleotide
  Target: ANGPTL3; (+) strand; PAM type: YTN; PAM sequence: TTA
caaatcggttaaattataca

SEQ ID NO: 14733 - DNA, 20 bp, Artificial Sequence
  Description of Artificial Sequence: Synthetic oligonucleotide
  Target: ANGPTL3; (+) strand; PAM type: YTN; PAM sequence: TTA
aattatacaatctagaacac

SEQ ID NO: 14734 - DNA, 20 bp, Artificial Sequence
  Description of Artificial Sequence: Synthetic oligonucleotide
  Target: ANGPTL3; (+) strand; PAM type: YTN; PAM sequence: TTA
tacaatctagaacactatgt

SEQ ID NO: 14735 - DNA, 20 bp, Artificial Sequence
  Description of Artificial Sequence: Synthetic oligonucleotide
  Target: ANGPTL3; (+) strand; PAM type: YTN; PAM sequence: CTA
gaacactatgtcattacact

SEQ ID NO: 14736 - DNA, 20 bp, Artificial Sequence
  Description of Artificial Sequence: Synthetic oligonucleotide
  Target: ANGPTL3; (+) strand; PAM type: YTN; PAM sequence: CTA
tgtcattacactattgtaaa

SEQ ID NO: 14737 - DNA, 20 bp, Artificial Sequence
  Description of Artificial Sequence: Synthetic oligonucleotide
  Target: ANGPTL3; (+) strand; PAM type: YTN; PAM sequence: TTA
cactattgtaaattactgaa

SEQ ID NO: 14738 - DNA, 20 bp, Artificial Sequence
  Description of Artificial Sequence: Synthetic oligonucleotide
  Target: ANGPTL3; (+) strand; PAM type: YTN; PAM sequence: CTA
ttgtaaattactgaaggtaa

SEQ ID NO: 14739 - DNA, 20 bp, Artificial Sequence
  Description of Artificial Sequence: Synthetic oligonucleotide
  Target: ANGPTL3; (+) strand; PAM type: YTN; PAM sequence: TTG
taaattactgaaggtaagta

SEQ ID NO: 14740 - DNA, 20 bp, Artificial Sequence
  Description of Artificial Sequence: Synthetic oligonucleotide
  Target: ANGPTL3; (+) strand; PAM type: YTN; PAM sequence: TTA
ctgaaggtaagtaaaaagtt

SEQ ID NO: 14741 - DNA, 20 bp, Artificial Sequence
  Description of Artificial Sequence: Synthetic oligonucleotide
  Target: ANGPTL3; (+) strand; PAM type: YTN; PAM sequence: CTG
aaggtaagtaaaaagttaaa

SEQ ID NO: 14742 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaaatttaaaactattc

SEQ ID NO: 14743 - DNA, 20 bp, Artificial Sequence
  Description of Artificial Sequence: Synthetic oligonucleotide
  Target: ANGPTL3; (+) strand; PAM type: YTN; PAM sequence: TTT
aaaactattctccagtgttt

SEQ ID NO: 14744 - DNA, 20 bp, Artificial Sequence
  Description of Artificial Sequence: Synthetic oligonucleotide
  Target: ANGPTL3; (+) strand; PAM type: YTN; PAM sequence: TTA
aaactattctccagtgttta

SEQ ID NO: 14745 - DNA, 20 bp, Artificial Sequence
  Description of Artificial Sequence: Synthetic oligonucleotide
  Target: ANGPTL3; (+) strand; PAM type: YTN; PAM sequence: CTA
ttctccagtgtttaaaacag

SEQ ID NO: 14746 - DNA, 20 bp, Artificial Sequence
  Description of Artificial Sequence: Synthetic oligonucleotide
  Target: ANGPTL3; (+) strand; PAM type: YTN; PAM sequence: TTC
tccagtgtttaaaacagatt

SEQ ID NO: 14747 - DNA, 20 bp, Artificial Sequence
  Description of Artificial Sequence: Synthetic oligonucleotide
  Target: ANGPTL3; (+) strand; PAM type: YTN; PAM sequence: CTC
cagtgtttaaaacagattaa

SEQ ID NO: 14748 - DNA, 20 bp, Artificial Sequence
  Description of Artificial Sequence: Synthetic oligonucleotide
  Target: ANGPTL3; (+) strand; PAM type: YTN; PAM sequence: TTT
aaaacagattaaataataca

SEQ ID NO: 14749 - DNA, 20 bp, Artificial Sequence
  Description of Artificial Sequence: Synthetic oligonucleotide
  Target: ANGPTL3; (+) strand; PAM type: YTN; PAM sequence: TTA
aaacagattaaataatacag

SEQ ID NO: 14750 - DNA, 20 bp, Artificial Sequence
  Description of Artificial Sequence: Synthetic oligonucleotide
  Target: ANGPTL3; (+) strand; PAM type: YTN; PAM sequence: TTA
aataatacagtaaatggaaa

SEQ ID NO: 14751 - DNA, 20 bp, Artificial Sequence
  Description of Artificial Sequence: Synthetic oligonucleotide
  Target: ANGPTL3; (+) strand; PAM type: YTN; PAM sequence: TTT
attcatatgaaaatatgctg

SEQ ID NO: 14752 - DNA, 20 bp, Artificial Sequence
  Description of Artificial Sequence: Synthetic oligonucleotide
  Target: ANGPTL3; (+) strand; PAM type: YTN; PAM sequence: TTA
ttcatatgaaaatatgctgg

SEQ ID NO: 14753 - DNA, 20 bp, Artificial Sequence
  Description of Artificial Sequence: Synthetic oligonucleotide
  Target: ANGPTL3; (+) strand; PAM type: YTN; PAM sequence: TTC
atatgaaaatatgctgggct

SEQ ID NO: 14754 - DNA, 20 bp, Artificial Sequence
  Description of Artificial Sequence: Synthetic oligonucleotide
  Target: ANGPTL3; (+) strand; PAM type: YTN; PAM sequence: CTG
ggctttttcttttaattgaa

SEQ ID NO: 14755 - DNA, 20 bp, Artificial Sequence
  Description of Artificial Sequence: Synthetic oligonucleotide
  Target: ANGPTL3; (+) strand; PAM type: YTN; PAM sequence: CTT
tttcttttaattgaagttca

SEQ ID NO: 14756 - DNA, 20 bp, Artificial Sequence
  Description of Artificial Sequence: Synthetic oligonucleotide
  Target: ANGPTL3; (+) strand; PAM type: YTN; PAM sequence: TTT
ttcttttaattgaagttcag

SEQ ID NO: 14757 - DNA, 20 bp, Artificial Sequence
  Description of Artificial Sequence: Synthetic oligonucleotide
  Target: ANGPTL3; (+) strand; PAM type: YTN; PAM sequence: TTT
tcttttaattgaagttcaga

SEQ ID NO: 14758 - DNA, 20 bp, Artificial Sequence
  Description of Artificial Sequence: Synthetic oligonucleotide
  Target: ANGPTL3; (+) strand; PAM type: YTN; PAM sequence: TTT
cttttaattgaagttcagaa

SEQ ID NO: 14759 - DNA, 20 bp, Artificial Sequence
  Description of Artificial Sequence: Synthetic oligonucleotide
  Target: ANGPTL3; (+) strand; PAM type: YTN; PAM sequence: TTC
ttttaattgaagttcagaaa

SEQ ID NO: 14760 - DNA, 20 bp, Artificial Sequence
  Description of Artificial Sequence: Synthetic oligonucleotide
  Target: ANGPTL3; (+) strand; PAM type: YTN; PAM sequence: CTT
ttaattgaagttcagaaaat

SEQ ID NO: 14761 - DNA, 20 bp, Artificial Sequence
  Description of Artificial Sequence: Synthetic oligonucleotide
  Target: ANGPTL3; (+) strand; PAM type: YTN; PAM sequence: TTT
taattgaagttcagaaaatc

SEQ ID NO: 14762 - DNA, 20 bp, Artificial Sequence
  Description of Artificial Sequence: Synthetic oligonucleotide
  Target: ANGPTL3; (+) strand; PAM type: YTN; PAM sequence: TTT
aattgaagttcagaaaatca

SEQ ID NO: 14763 - DNA, 20 bp, Artificial Sequence
  Description of Artificial Sequence: Synthetic oligonucleotide
  Target: ANGPTL3; (+) strand; PAM type: YTN; PAM sequence: TTA
attgaagttcagaaaatcaa

SEQ ID NO: 14764 - DNA, 20 bp, Artificial Sequence
  Description of Artificial Sequence: Synthetic oligonucleotide
  Target: ANGPTL3; (+) strand; PAM type: YTN; PAM sequence: TTG
aagttcagaaaatcaaattt

SEQ ID NO: 14765 - DNA, 20 bp, Artificial Sequence
  Description of Artificial Sequence: Synthetic oligonucleotide
  Target: ANGPTL3; (+) strand; PAM type: YTN; PAM sequence: TTC
agaaaatcaaattttagaga

SEQ ID NO: 14766 - DNA, 20 bp, Artificial Sequence
  Description of Artificial Sequence: Synthetic oligonucleotide
  Target: ANGPTL3; (+) strand; PAM type: YTN; PAM sequence: TTT
tagagatagtacaatttaaa

SEQ ID NO: 14767 - DNA, 20 bp, Artificial Sequence
  Description of Artificial Sequence: Synthetic oligonucleotide
  Target: ANGPTL3; (+) strand; PAM type: YTN; PAM sequence: TTT
agagatagtacaatttaaat

SEQ ID NO: 14768 - DNA, 20 bp, Artificial Sequence
  Description of Artificial Sequence: Synthetic oligonucleotide
  Target: ANGPTL3; (+) strand; PAM type: YTN; PAM sequence: TTA
gagatagtacaatttaaata

SEQ ID NO: 14769 - DNA, 20 bp, Artificial Sequence
  Description of Artificial Sequence: Synthetic oligonucleotide
  Target: ANGPTL3; (+) strand; PAM type: YTN; PAM sequence: TTT
aaataaaatgttaaggacaa

SEQ ID NO: 14770 - DNA, 20 bp, Artificial Sequence
  Description of Artificial Sequence: Synthetic oligonucleotide
  Target: ANGPTL3; (+) strand; PAM type: YTN; PAM sequence: TTA
aataaaatgttaaggacaaa

SEQ ID NO: 14771 - DNA, 20 bp, Artificial Sequence
  Description of Artificial Sequence: Synthetic oligonucleotide
  Target: ANGPTL3; (+) strand; PAM type: YTN; PAM sequence: TTA
aggacaaaaatatgtgctat

SEQ ID NO: 14772 - DNA, 20 bp, Artificial Sequence
  Description of Artificial Sequence: Synthetic oligonucleotide
  Target: ANGPTL3; (+) strand; PAM type: YTN; PAM sequence: CTA
tttgaaagaagcatacaagg

SEQ ID NO: 14773 - DNA, 20 bp, Artificial Sequence
  Description of Artificial Sequence: Synthetic oligonucleotide
  Target: ANGPTL3; (+) strand; PAM type: YTN; PAM sequence: TTT
gaaagaagcatacaagggga

SEQ ID NO: 14774 - DNA, 20 bp, Artificial Sequence
  Description of Artificial Sequence: Synthetic oligonucleotide
  Target: ANGPTL3; (+) strand; PAM type: YTN; PAM sequence: TTG
aaagaagcatacaaggggaa

SEQ ID NO: 14775 - DNA, 20 bp, Artificial Sequence
  Description of Artificial Sequence: Synthetic oligonucleotide
  Target: ANGPTL3; (+) strand; PAM type: YTN; PAM sequence: TTG
ccaatattcatttttcaaat

SEQ ID NO: 14776 - DNA, 20 bp, Artificial Sequence
  Description of Artificial Sequence: Synthetic oligonucleotide
  Target: ANGPTL3; (+) strand; PAM type: YTN; PAM sequence: TTC
atttttcaaatccattatta

SEQ ID NO: 14777 - DNA, 20 bp, Artificial Sequence
  Description of Artificial Sequence: Synthetic oligonucleotide
  Target: ANGPTL3; (+) strand; PAM type: YTN; PAM sequence: TTT
ttcaaatccattattagttt

SEQ ID NO: 14778 - DNA, 20 bp, Artificial Sequence
  Description of Artificial Sequence: Synthetic oligonucleotide
  Target: ANGPTL3; (+) strand; PAM type: YTN; PAM sequence: TTT
tcaaatccattattagttta

SEQ ID NO: 14779 - DNA, 20 bp, Artificial Sequence
  Description of Artificial Sequence: Synthetic oligonucleotide
  Target: ANGPTL3; (+) strand; PAM type: YTN; PAM sequence: TTT
caaatccattattagtttaa

SEQ ID NO: 14780 - DNA, 20 bp, Artificial Sequence
  Description of Artificial Sequence: Synthetic oligonucleotide
  Target: ANGPTL3; (+) strand; PAM type: YTN; PAM sequence: TTC
aaatccattattagtttaaa

SEQ ID NO: 14781 - DNA, 20 bp, Artificial Sequence
  Description of Artificial Sequence: Synthetic oligonucleotide
  Target: ANGPTL3; (+) strand; PAM type: YTN; PAM sequence: TTA
ttagtttaaaaatttagatt

SEQ ID NO: 14782 - DNA, 20 bp, Artificial Sequence
  Description of Artificial Sequence: Synthetic oligonucleotide
  Target: ANGPTL3; (+) strand; PAM type: YTN; PAM sequence: TTA
gtttaaaaatttagattatg

SEQ ID NO: 14783 - DNA, 20 bp, Artificial Sequence
  Description of Artificial Sequence: Synthetic oligonucleotide
  Target: ANGPTL3; (+) strand; PAM type: YTN; PAM sequence: TTT
aaaaatttagattatgatag

SEQ ID NO: 14784 - DNA, 20 bp, Artificial Sequence
  Description of Artificial Sequence: Synthetic oligonucleotide
  Target: ANGPTL3; (+) strand; PAM type: YTN; PAM sequence: TTA
aaaatttagattatgatagt

SEQ ID NO: 14785 - DNA, 20 bp, Artificial Sequence
  Description of Artificial Sequence: Synthetic oligonucleotide
  Target: ANGPTL3; (+) strand; PAM type: YTN; PAM sequence: TTT
agattatgatagtgttacag

SEQ ID NO: 14786 - DNA, 20 bp, Artificial Sequence
  Description of Artificial Sequence: Synthetic oligonucleotide
  Target: ANGPTL3; (+) strand; PAM type: YTN; PAM sequence: TTA
gattatgatagtgttacagg

SEQ ID NO: 14787 - DNA, 20 bp, Artificial Sequence
  Description of Artificial Sequence: Synthetic oligonucleotide
  Target: ANGPTL3; (+) strand; PAM type: YTN; PAM sequence: TTA
tgatagtgttacaggaaatt

SEQ ID NO: 14788 - DNA, 20 bp, Artificial Sequence
  Description of Artificial Sequence: Synthetic oligonucleotide
  Target: ANGPTL3; (+) strand; PAM type: YTN; PAM sequence: TTA
caggaaattaatagaaaaga

SEQ ID NO: 14789 - DNA, 20 bp, Artificial Sequence
  Description of Artificial Sequence: Synthetic oligonucleotide
  Target: ANGPTL3; (+) strand; PAM type: YTN; PAM sequence: TTA
atagaaaagaaagaggaaag

SEQ ID NO: 14790 - DNA, 20 bp, Artificial Sequence
  Description of Artificial Sequence: Synthetic oligonucleotide
  Target: ANGPTL3; (+) strand; PAM type: YTN; PAM sequence: CTT
ataaccaacctactctctat

SEQ ID NO: 14791 - DNA, 20 bp, Artificial Sequence
  Description of Artificial Sequence: Synthetic oligonucleotide
  Target: ANGPTL3; (+) strand; PAM type: YTN; PAM sequence: TTA
taaccaacctactctctata

SEQ ID NO: 14792 - DNA, 20 bp, Artificial Sequence
  Description of Artificial Sequence: Synthetic oligonucleotide
  Target: ANGPTL3; (+) strand; PAM type: YTN; PAM sequence: CTA
ctctctatatccagactttt

SEQ ID NO: 14793 - DNA, 20 bp, Artificial Sequence
  Description of Artificial Sequence: Synthetic oligonucleotide
  Target: ANGPTL3; (+) strand; PAM type: YTN; PAM sequence: CTC
tctatatccagacttttgta

SEQ ID NO: 14794 - DNA, 20 bp, Artificial Sequence
  Description of Artificial Sequence: Synthetic oligonucleotide
  Target: ANGPTL3; (+) strand; PAM type: YTN; PAM sequence: CTC
tatatccagacttttgtaga

SEQ ID NO: 14795 - DNA, 20 bp, Artificial Sequence
  Description of Artificial Sequence: Synthetic oligonucleotide
  Target: ANGPTL3; (+) strand; PAM type: YTN; PAM sequence: CTA
tatccagacttttgtagaaa

SEQ ID NO: 14796 - DNA, 20 bp, Artificial Sequence
  Description of Artificial Sequence: Synthetic oligonucleotide
  Target: ANGPTL3; (+) strand; PAM type: YTN; PAM sequence: CTT
ttgtagaaaaacaagataat

SEQ ID NO: 14797 - DNA, 20 bp, Artificial Sequence
  Description of Artificial Sequence: Synthetic oligonucleotide
  Target: ANGPTL3; (+) strand; PAM type: YTN; PAM sequence: TTT
tgtagaaaaacaagataata

SEQ ID NO: 14798 - DNA, 20 bp, Artificial Sequence
  Description of Artificial Sequence: Synthetic oligonucleotide
  Target: ANGPTL3; (+) strand; PAM type: YTN; PAM sequence: TTT
gtagaaaaacaagataatag

SEQ ID NO: 14799 - DNA, 20 bp, Artificial Sequence
  Description of Artificial Sequence: Synthetic oligonucleotide
  Target: ANGPTL3; (+) strand; PAM type: YTN; PAM sequence: TTG
tagaaaaacaagataatagc

SEQ ID NO: 14800 - DNA, 20 bp, Artificial Sequence
  Description of Artificial Sequence: Synthetic oligonucleotide
  Target: ANGPTL3; (+) strand; PAM type: YTN; PAM sequence: CTT
ctccagaccgtggaagacca

SEQ ID NO: 14801 - DNA, 20 bp, Artificial Sequence
  Description of Artificial Sequence: Synthetic oligonucleotide
  Target: ANGPTL3; (+) strand; PAM type: YTN; PAM sequence: TTC
tccagaccgtggaagaccaa

SEQ ID NO: 14802 - DNA, 20 bp, Artificial Sequence
  Description of Artificial Sequence: Synthetic oligonucleotide
  Target: ANGPTL3; (+) strand; PAM type: YTN; PAM sequence: CTC
cagaccgtggaagaccaata

SEQ ID NO: 14803 - DNA, 20 bp, Artificial Sequence
  Description of Artificial Sequence: Synthetic oligonucleotide
  Target: ANGPTL3; (+) strand; PAM type: YTN; PAM sequence: TTA
aaccaacagcatagtcaaat

SEQ ID NO: 14804 - DNA, 20 bp, Artificial Sequence
  Description of Artificial Sequence: Synthetic oligonucleotide
  Target: ANGPTL3; (+) strand; PAM type: YTN; PAM sequence: TTT
taatggtatgtcccatcttt

SEQ ID NO: 14805 - DNA, 20 bp, Artificial Sequence
  Description of Artificial Sequence: Synthetic oligonucleotide
  Target: ANGPTL3; (+) strand; PAM type: YTN; PAM sequence: TTT
aatggtatgtcccatctttc

SEQ ID NO: 14806 - DNA, 20 bp, Artificial Sequence
  Description of Artificial Sequence: Synthetic oligonucleotide
  Target: ANGPTL3; (+) strand; PAM type: YTN; PAM sequence: TTA
atggtatgtcccatctttca

SEQ ID NO: 14807 - DNA, 20 bp, Artificial Sequence
  Description of Artificial Sequence: Synthetic oligonucleotide
  Target: ANGPTL3; (+) strand; PAM type: YTN; PAM sequence: CTT
tcacacaggtctgtaaaaac

SEQ ID NO: 14808 - DNA, 20 bp, Artificial Sequence
  Description of Artificial Sequence: Synthetic oligonucleotide
  Target: ANGPTL3; (+) strand; PAM type: YTN; PAM sequence: TTT
cacacaggtctgtaaaaaca

SEQ ID NO: 14809 - DNA, 20 bp, Artificial Sequence
  Description of Artificial Sequence: Synthetic oligonucleotide
  Target: ANGPTL3; (+) strand; PAM type: YTN; PAM sequence: TTC
acacaggtctgtaaaaacac

SEQ ID NO: 14810 - DNA, 20 bp, Artificial Sequence
  Description of Artificial Sequence: Synthetic oligonucleotide
  Target: ANGPTL3; (+) strand; PAM type: YTN; PAM sequence: CTG
taaaaacactgaatcctaaa

SEQ ID NO: 14811 - DNA, 20 bp, Artificial Sequence
  Description of Artificial Sequence: Synthetic oligonucleotide
  Target: ANGPTL3; (+) strand; PAM type: YTN; PAM sequence: CTG
aatcctaaaattatttacaa

SEQ ID NO: 14812 - DNA, 20 bp, Artificial Sequence
  Description of Artificial Sequence: Synthetic oligonucleotide
  Target: ANGPTL3; (+) strand; PAM type: YTN; PAM sequence: CTA
aaattatttacaagctttaa

SEQ ID NO: 14813 - DNA, 20 bp, Artificial Sequence
  Description of Artificial Sequence: Synthetic oligonucleotide
  Target: ANGPTL3; (+) strand; PAM type: YTN; PAM sequence: TTA
tttacaagctttaactggat

SEQ ID NO: 14814 - DNA, 20 bp, Artificial Sequence
  Description of Artificial Sequence: Synthetic oligonucleotide
  Target: ANGPTL3; (+) strand; PAM type: YTN; PAM sequence: TTT
acaagctttaactggatcat

SEQ ID NO: 14815 - DNA, 20 bp, Artificial Sequence
  Description of Artificial Sequence: Synthetic oligonucleotide
  Target: ANGPTL3; (+) strand; PAM type: YTN; PAM sequence: TTA
caagctttaactggatcatg

SEQ ID NO: 14816 - DNA, 20 bp, Artificial Sequence
  Description of Artificial Sequence: Synthetic oligonucleotide
  Target: ANGPTL3; (+) strand; PAM type: YTN; PAM sequence: CTT
taactggatcatgagtaaaa

SEQ ID NO: 14817 - DNA, 20 bp, Artificial Sequence
  Description of Artificial Sequence: Synthetic oligonucleotide
  Target: ANGPTL3; (+) strand; PAM type: YTN; PAM sequence: TTT
aactggatcatgagtaaaat

SEQ ID NO: 14818 - DNA, 20 bp, Artificial Sequence
  Description of Artificial Sequence: Synthetic oligonucleotide
  Target: ANGPTL3; (+) strand; PAM type: YTN; PAM sequence: TTA
actggatcatgagtaaaatt

SEQ ID NO: 14819 - DNA, 20 bp, Artificial Sequence
  Description of Artificial Sequence: Synthetic oligonucleotide
  Target: ANGPTL3; (+) strand; PAM type: YTN; PAM sequence: CTG
gatcatgagtaaaattatca

SEQ ID NO: 14820 - DNA, 20 bp, Artificial Sequence
  Description of Artificial Sequence: Synthetic oligonucleotide
  Target: ANGPTL3; (+) strand; PAM type: YTN; PAM sequence: TTA
tcacatcagcataactgtta

SEQ ID NO: 14821 - DNA, 20 bp, Artificial Sequence
  Description of Artificial Sequence: Synthetic oligonucleotide
  Target: ANGPTL3; (+) strand; PAM type: YTN; PAM sequence: CTG
ttaaaattgcaggctctgaa

SEQ ID NO: 14822 - DNA, 20 bp, Artificial Sequence
  Description of Artificial Sequence: Synthetic oligonucleotide
  Target: ANGPTL3; (+) strand; PAM type: YTN; PAM sequence: TTA
aaattgcaggctctgaagct

SEQ ID NO: 14823 - DNA, 20 bp, Artificial Sequence
  Description of Artificial Sequence: Synthetic oligonucleotide
  Target: ANGPTL3; (+) strand; PAM type: YTN; PAM sequence: TTG
caggctctgaagctaataaa

SEQ ID NO: 14824 - DNA, 20 bp, Artificial Sequence
  Description of Artificial Sequence: Synthetic oligonucleotide
  Target: ANGPTL3; (+) strand; PAM type: YTN; PAM sequence: CTC
tgaagctaataaactacctg

SEQ ID NO: 14825 - DNA, 20 bp, Artificial Sequence
  Description of Artificial Sequence: Synthetic oligonucleotide
  Target: ANGPTL3; (+) strand; PAM type: YTN; PAM sequence: CTG
aagctaataaactacctgca

SEQ ID NO: 14826 - DNA, 20 bp, Artificial Sequence
  Description of Artificial Sequence: Synthetic oligonucleotide
  Target: ANGPTL3; (+) strand; PAM type: YTN; PAM sequence: CTA
ataaactacctgcatttaaa

SEQ ID NO: 14827 - DNA, 20 bp, Artificial Sequence
  Description of Artificial Sequence: Synthetic oligonucleotide
  Target: ANGPTL3; (+) strand; PAM type: YTN; PAM sequence: CTA
cctgcatttaaaccatggct

SEQ ID NO: 14828 - DNA, 20 bp, Artificial Sequence
  Description of Artificial Sequence: Synthetic oligonucleotide
  Target: ANGPTL3; (+) strand; PAM type: YTN; PAM sequence: CTG
catttaaaccatggctctaa

SEQ ID NO: 14829 - DNA, 20 bp, Artificial Sequence
  Description of Artificial Sequence: Synthetic oligonucleotide
  Target: ANGPTL3; (+) strand; PAM type: YTN; PAM sequence: TTT
aaaccatggctctaaaactt

SEQ ID NO: 14830 - DNA, 20 bp, Artificial Sequence
  Description of Artificial Sequence: Synthetic oligonucleotide
  Target: ANGPTL3; (+) strand; PAM type: YTN; PAM sequence: TTA
aaccatggctctaaaacttt

SEQ ID NO: 14831 - DNA, 20 bp, Artificial Sequence
  Description of Artificial Sequence: Synthetic oligonucleotide
  Target: ANGPTL3; (+) strand; PAM type: YTN; PAM sequence: CTC
taaaactttgtgtgaccttg

SEQ ID NO: 14832 - DNA, 20 bp, Artificial Sequence
  Description of Artificial Sequence: Synthetic oligonucleotide
  Target: ANGPTL3; (+) strand; PAM type: YTN; PAM sequence: CTA
aaactttgtgtgaccttgaa

SEQ ID NO: 14833 - DNA, 20 bp, Artificial Sequence
  Description of Artificial Sequence: Synthetic oligonucleotide
  Target: ANGPTL3; (+) strand; PAM type: YTN; PAM sequence: CTT
tgtgtgaccttgaataaatt

SEQ ID NO: 14834 - DNA, 20 bp, Artificial Sequence
  Description of Artificial Sequence: Synthetic oligonucleotide
  Target: ANGPTL3; (+) strand; PAM type: YTN; PAM sequence: TTT
gtgtgaccttgaataaatta

SEQ ID NO: 14835 - DNA, 20 bp, Artificial Sequence
  Description of Artificial Sequence: Synthetic oligonucleotide
  Target: ANGPTL3; (+) strand; PAM type: YTN; PAM sequence: TTG
tgtgaccttgaataaattac

SEQ ID NO: 14836 - DNA, 20 bp, Artificial Sequence
  Description of Artificial Sequence: Synthetic oligonucleotide
  Target: ANGPTL3; (+) strand; PAM type: YTN; PAM sequence: CTT
gaataaattacttcacccct

SEQ ID NO: 14837 - DNA, 20 bp, Artificial Sequence
  Description of Artificial Sequence: Synthetic oligonucleotide
  Target: ANGPTL3; (+) strand; PAM type: YTN; PAM sequence: TTG
aataaattacttcacccctt

SEQ ID NO: 14838 - DNA, 20 bp, Artificial Sequence
  Description of Artificial Sequence: Synthetic oligonucleotide
  Target: ANGPTL3; (+) strand; PAM type: YTN; PAM sequence: TTA
cttcacccctttatctctca

SEQ ID NO: 14839 - DNA, 20 bp, Artificial Sequence
  Description of Artificial Sequence: Synthetic oligonucleotide
  Target: ANGPTL3; (+) strand; PAM type: YTN; PAM sequence: CTT
cacccctttatctctcagtt

SEQ ID NO: 14840 - DNA, 20 bp, Artificial Sequence
  Description of Artificial Sequence: Synthetic oligonucleotide
  Target: ANGPTL3; (+) strand; PAM type: YTN; PAM sequence: TTC
acccctttatctctcagttt

SEQ ID NO: 14841 - DNA, 20 bp, Artificial Sequence
  Description of Artificial Sequence: Synthetic oligonucleotide
  Target: ANGPTL3; (+) strand; PAM type: YTN; PAM sequence: CTT
tatctctcagtttcctcaca

SEQ ID NO: 14842 - DNA, 20 bp, Artificial Sequence
  Description of Artificial Sequence: Synthetic oligonucleotide
  Target: ANGPTL3; (+) strand; PAM type: YTN; PAM sequence: TTT
atctctcagtttcctcacat

SEQ ID NO: 14843 - DNA, 20 bp, Artificial Sequence
  Description of Artificial Sequence: Synthetic oligonucleotide
  Target: ANGPTL3; (+) strand; PAM type: YTN; PAM sequence: TTA
tctctcagtttcctcacata

SEQ ID NO: 14844 - DNA, 20 bp, Artificial Sequence
  Description of Artificial Sequence: Synthetic oligonucleotide
  Target: ANGPTL3; (+) strand; PAM type: YTN; PAM sequence: CTC
tcagtttcctcacatatact

SEQ ID NO: 14845 - DNA, 20 bp, Artificial Sequence
  Description of Artificial Sequence: Synthetic oligonucleotide
  Target: ANGPTL3; (+) strand; PAM type: YTN; PAM sequence: CTC
agtttcctcacatatactac

SEQ ID NO: 14846 - DNA, 20 bp, Artificial Sequence
  Description of Artificial Sequence: Synthetic oligonucleotide
  Target: ANGPTL3; (+) strand; PAM type: YTN; PAM sequence: TTT
cctcacatatactacaaaga

SEQ ID NO: 14847 - DNA, 20 bp, Artificial Sequence
  Description of Artificial Sequence: Synthetic oligonucleotide
  Target: ANGPTL3; (+) strand; PAM type: YTN; PAM sequence: TTC
ctcacatatactacaaagat

SEQ ID NO: 14848 - DNA, 20 bp, Artificial Sequence
  Description of Artificial Sequence: Synthetic oligonucleotide
  Target: ANGPTL3; (+) strand; PAM type: YTN; PAM sequence: CTC
acatatactacaaagataat

SEQ ID NO: 14849 - DNA, 20 bp, Artificial Sequence
  Description of Artificial Sequence: Synthetic oligonucleotide
  Target: ANGPTL3; (+) strand; PAM type: YTN; PAM sequence: CTA
caaagataataacagaactt

SEQ ID NO: 14850 - DNA, 20 bp, Artificial Sequence
  Description of Artificial Sequence: Synthetic oligonucleotide
  Target: ANGPTL3; (+) strand; PAM type: YTN; PAM sequence: CTT
ataggattattgtaagaaaa

SEQ ID NO: 14851 - DNA, 20 bp, Artificial Sequence
  Description of Artificial Sequence: Synthetic oligonucleotide
  Target: ANGPTL3; (+) strand; PAM type: YTN; PAM sequence: TTA
taggattattgtaagaaaaa

SEQ ID NO: 14852 - DNA, 20 bp, Artificial Sequence
  Description of Artificial Sequence: Synthetic oligonucleotide
  Target: ANGPTL3; (+) strand; PAM type: YTN; PAM sequence: TTA
ttgtaagaaaaaaaattaat

SEQ ID NO: 14853 - DNA, 20 bp, Artificial Sequence
  Description of Artificial Sequence: Synthetic oligonucleotide
  Target: ANGPTL3; (+) strand; PAM type: YTN; PAM sequence: TTG
taagaaaaaaaattaattca

SEQ ID NO: 14854 - DNA, 20 bp, Artificial Sequence
  Description of Artificial Sequence: Synthetic oligonucleotide
  Target: ANGPTL3; (+) strand; PAM type: YTN; PAM sequence: TTA
attcatagcagccaatgtca

SEQ ID NO: 14855 - DNA, 20 bp, Artificial Sequence
  Description of Artificial Sequence: Synthetic oligonucleotide
  Target: ANGPTL3; (+) strand; PAM type: YTN; PAM sequence: TTC
atagcagccaatgtcatctt

SEQ ID NO: 14856 - DNA, 20 bp, Artificial Sequence
  Description of Artificial Sequence: Synthetic oligonucleotide
  Target: ANGPTL3; (+) strand; PAM type: YTN; PAM sequence: CTT
actaaaattcaaattagatc

SEQ ID NO: 14857 - DNA, 20 bp, Artificial Sequence
  Description of Artificial Sequence: Synthetic oligonucleotide
  Target: ANGPTL3; (+) strand; PAM type: YTN; PAM sequence: TTA
ctaaaattcaaattagatca

SEQ ID NO: 14858 - DNA, 20 bp, Artificial Sequence
  Description of Artificial Sequence: Synthetic oligonucleotide
  Target: ANGPTL3; (+) strand; PAM type: YTN; PAM sequence: CTA
aaattcaaattagatcatgt

SEQ ID NO: 14859 - DNA, 20 bp, Artificial Sequence
  Description of Artificial Sequence: Synthetic oligonucleotide
  Target: ANGPTL3; (+) strand; PAM type: YTN; PAM sequence: TTC
aaattagatcatgtttctct

SEQ ID NO: 14860 - DNA, 20 bp, Artificial Sequence
  Description of Artificial Sequence: Synthetic oligonucleotide
  Target: ANGPTL3; (+) strand; PAM type: YTN; PAM sequence: TTA
gatcatgtttctctttgctc

SEQ ID NO: 14861 - DNA, 20 bp, Artificial Sequence
  Description of Artificial Sequence: Synthetic oligonucleotide
  Target: ANGPTL3; (+) strand; PAM type: YTN; PAM sequence: TTT
ctctttgctcaaaaccacac

SEQ ID NO: 14862 - DNA, 20 bp, Artificial Sequence
  Description of Artificial Sequence: Synthetic oligonucleotide
  Target: ANGPTL3; (+) strand; PAM type: YTN; PAM sequence: TTC
tctttgctcaaaaccacaca

SEQ ID NO: 14863 - DNA, 20 bp, Artificial Sequence
  Description of Artificial Sequence: Synthetic oligonucleotide
  Target: ANGPTL3; (+) strand; PAM type: YTN; PAM sequence: CTC
tttgctcaaaaccacacaat

SEQ ID NO: 14864 - DNA, 20 bp, Artificial Sequence
  Description of Artificial Sequence: Synthetic oligonucleotide
  Target: ANGPTL3; (+) strand; PAM type: YTN; PAM sequence: CTT
tgctcaaaaccacacaatag

SEQ ID NO: 14865 - DNA, 20 bp, Artificial Sequence
  Description of Artificial Sequence: Synthetic oligonucleotide
  Target: ANGPTL3; (+) strand; PAM type: YTN; PAM sequence: TTT
gctcaaaaccacacaatagc

SEQ ID NO: 14866 - DNA, 20 bp, Artificial Sequence
  Description of Artificial Sequence: Synthetic oligonucleotide
  Target: ANGPTL3; (+) strand; PAM type: YTN; PAM sequence: TTG
ctcaaaaccacacaatagct

SEQ ID NO: 14867 - DNA, 20 bp, Artificial Sequence
  Description of Artificial Sequence: Synthetic oligonucleotide
  Target: ANGPTL3; (+) strand; PAM type: YTN; PAM sequence: CTC
aaaaccacacaatagctttc

SEQ ID NO: 14868 - DNA, 20 bp, Artificial Sequence
  Description of Artificial Sequence: Synthetic oligonucleotide
  Target: ANGPTL3; (+) strand; PAM type: YTN; PAM sequence: CTT
tccatttcactcatattggc

SEQ ID NO: 14869 - DNA, 20 bp, Artificial Sequence
  Description of Artificial Sequence: Synthetic oligonucleotide
  Target: ANGPTL3; (+) strand; PAM type: YTN; PAM sequence: TTT
ccatttcactcatattggct

SEQ ID NO: 14870 - DNA, 20 bp, Artificial Sequence
  Description of Artificial Sequence: Synthetic oligonucleotide
  Target: ANGPTL3; (+) strand; PAM type: YTN; PAM sequence: TTC
catttcactcatattggctc

SEQ ID NO: 14871 - DNA, 20 bp, Artificial Sequence
  Description of Artificial Sequence: Synthetic oligonucleotide
  Target: ANGPTL3; (+) strand; PAM type: YTN; PAM sequence: TTT
cactcatattggctctttag

SEQ ID NO: 14872 - DNA, 20 bp, Artificial Sequence
  Description of Artificial Sequence: Synthetic oligonucleotide
  Target: ANGPTL3; (+) strand; PAM type: YTN; PAM sequence: TTC
actcatattggctctttaga

SEQ ID NO: 14873 - DNA, 20 bp, Artificial Sequence
  Description of Artificial Sequence: Synthetic oligonucleotide
  Target: ANGPTL3; (+) strand; PAM type: YTN; PAM sequence: CTC
atattggctctttagaccaa

SEQ ID NO: 14874 - DNA, 20 bp, Artificial Sequence
  Description of Artificial Sequence: Synthetic oligonucleotide
  Target: ANGPTL3; (+) strand; PAM type: YTN; PAM sequence: TTG
gctctttagaccaagattac

SEQ ID NO: 14875 - DNA, 20 bp, Artificial Sequence
  Description of Artificial Sequence: Synthetic oligonucleotide
  Target: ANGPTL3; (+) strand; PAM type: YTN; PAM sequence: CTC
tttagaccaagattacccaa

SEQ ID NO: 14876 - DNA, 20 bp, Artificial Sequence
  Description of Artificial Sequence: Synthetic oligonucleotide
  Target: ANGPTL3; (+) strand; PAM type: YTN; PAM sequence: CTT
tagaccaagattacccaacc

SEQ ID NO: 14877 - DNA, 20 bp, Artificial Sequence
  Description of Artificial Sequence: Synthetic oligonucleotide
  Target: ANGPTL3; (+) strand; PAM type: YTN; PAM sequence: TTT
agaccaagattacccaaccc

SEQ ID NO: 14878 - DNA, 20 bp, Artificial Sequence
  Description of Artificial Sequence: Synthetic oligonucleotide
  Target: ANGPTL3; (+) strand; PAM type: YTN; PAM sequence: TTA
gaccaagattacccaaccct

SEQ ID NO: 14879 - DNA, 20 bp, Artificial Sequence
  Description of Artificial Sequence: Synthetic oligonucleotide
  Target: ANGPTL3; (+) strand; PAM type: YTN; PAM sequence: TTA
cccaacccttcgtcatctca

SEQ ID NO: 14880 - DNA, 20 bp, Artificial Sequence
  Description of Artificial Sequence: Synthetic oligonucleotide
  Target: ANGPTL3; (+) strand; PAM type: YTN; PAM sequence: CTT
cgtcatctcactgacttcac

SEQ ID NO: 14881 - DNA, 20 bp, Artificial Sequence
  Description of Artificial Sequence: Synthetic oligonucleotide
  Target: ANGPTL3; (+) strand; PAM type: YTN; PAM sequence: TTC
gtcatctcactgacttcacc

SEQ ID NO: 14882 - DNA, 20 bp, Artificial Sequence
  Description of Artificial Sequence: Synthetic oligonucleotide
  Target: ANGPTL3; (+) strand; PAM type: YTN; PAM sequence: CTC
actgacttcacctcctctac

SEQ ID NO: 14883 - DNA, 20 bp, Artificial Sequence
  Description of Artificial Sequence: Synthetic oligonucleotide
  Target: ANGPTL3; (+) strand; PAM type: YTN; PAM sequence: CTG
acttcacctcctctactcta

SEQ ID NO: 14884 - DNA, 20 bp, Artificial Sequence
  Description of Artificial Sequence: Synthetic oligonucleotide
  Target: ANGPTL3; (+) strand; PAM type: YTN; PAM sequence: CTT
cacctcctctactctagtta

SEQ ID NO: 14885 - DNA, 20 bp, Artificial Sequence
  Description of Artificial Sequence: Synthetic oligonucleotide
  Target: ANGPTL3; (+) strand; PAM type: YTN; PAM sequence: TTC
acctcctctactctagttat

SEQ ID NO: 14886 - DNA, 20 bp, Artificial Sequence
  Description of Artificial Sequence: Synthetic oligonucleotide
  Target: ANGPTL3; (+) strand; PAM type: YTN; PAM sequence: CTC
ctctactctagttattctga

SEQ ID NO: 14887 - DNA, 20 bp, Artificial Sequence
  Description of Artificial Sequence: Synthetic oligonucleotide
  Target: ANGPTL3; (+) strand; PAM type: YTN; PAM sequence: CTC
tactctagttattctgaccg

SEQ ID NO: 14888 - DNA, 20 bp, Artificial Sequence
  Description of Artificial Sequence: Synthetic oligonucleotide
  Target: ANGPTL3; (+) strand; PAM type: YTN; PAM sequence: CTA
ctctagttattctgaccgct

SEQ ID NO: 14889 - DNA, 20 bp, Artificial Sequence
  Description of Artificial Sequence: Synthetic oligonucleotide
  Target: ANGPTL3; (+) strand; PAM type: YTN; PAM sequence: CTC
tagttattctgaccgcttta

SEQ ID NO: 14890 - DNA, 20 bp, Artificial Sequence
  Description of Artificial Sequence: Synthetic oligonucleotide
  Target: ANGPTL3; (+) strand; PAM type: YTN; PAM sequence: CTA
gttattctgaccgctttacc

SEQ ID NO: 14891 - DNA, 20 bp, Artificial Sequence
  Description of Artificial Sequence: Synthetic oligonucleotide
  Target: ANGPTL3; (+) strand; PAM type: YTN; PAM sequence: TTA
ttctgaccgctttaccagta

SEQ ID NO: 14892 - DNA, 20 bp, Artificial Sequence
  Description of Artificial Sequence: Synthetic oligonucleotide
  Target: ANGPTL3; (+) strand; PAM type: YTN; PAM sequence: TTC
tgaccgctttaccagtattc

SEQ ID NO: 14893 - DNA, 20 bp, Artificial Sequence
  Description of Artificial Sequence: Synthetic oligonucleotide
  Target: ANGPTL3; (+) strand; PAM type: YTN; PAM sequence: CTG
accgctttaccagtattcaa

SEQ ID NO: 14894 - DNA, 20 bp, Artificial Sequence
  Description of Artificial Sequence: Synthetic oligonucleotide
  Target: ANGPTL3; (+) strand; PAM type: YTN; PAM sequence: CTT
taccagtattcaaacacatc

SEQ ID NO: 14895 - DNA, 20 bp, Artificial Sequence
  Description of Artificial Sequence: Synthetic oligonucleotide
  Target: ANGPTL3; (+) strand; PAM type: YTN; PAM sequence: TTT
accagtattcaaacacatca

SEQ ID NO: 14896 - DNA, 20 bp, Artificial Sequence
  Description of Artificial Sequence: Synthetic oligonucleotide
  Target: ANGPTL3; (+) strand; PAM type: YTN; PAM sequence: TTA
ccagtattcaaacacatcaa

SEQ ID NO: 14897 - DNA, 20 bp, Artificial Sequence
  Description of Artificial Sequence: Synthetic oligonucleotide
  Target: ANGPTL3; (+) strand; PAM type: YTN; PAM sequence: TTC
aaacacatcaaacatactgc

SEQ ID NO: 14898 - DNA, 20 bp, Artificial Sequence
  Description of Artificial Sequence: Synthetic oligonucleotide
  Target: ANGPTL3; (+) strand; PAM type: YTN; PAM sequence: CTG
ccacctcaaagcctttgccc

SEQ ID NO: 14899 - DNA, 20 bp, Artificial Sequence
  Description of Artificial Sequence: Synthetic oligonucleotide
  Target: ANGPTL3; (+) strand; PAM type: YTN; PAM sequence: CTC
aaagcctttgcccttgttgt

SEQ ID NO: 14900 - DNA, 20 bp, Artificial Sequence
  Description of Artificial Sequence: Synthetic oligonucleotide
  Target: ANGPTL3; (+) strand; PAM type: YTN; PAM sequence: CTT
tgcccttgttgtttcctcta

SEQ ID NO: 14901 - DNA, 20 bp, Artificial Sequence
  Description of Artificial Sequence: Synthetic oligonucleotide
  Target: ANGPTL3; (+) strand; PAM type: YTN; PAM sequence: TTT
gcccttgttgtttcctctaa

SEQ ID NO: 14902 - DNA, 20 bp, Artificial Sequence
  Description of Artificial Sequence: Synthetic oligonucleotide
  Target: ANGPTL3; (+) strand; PAM type: YTN; PAM sequence: TTG
cccttgttgtttcctctaac

SEQ ID NO: 14903 - DNA, 20 bp, Artificial Sequence
  Description of Artificial Sequence: Synthetic oligonucleotide
  Target: ANGPTL3; (+) strand; PAM type: YTN; PAM sequence: CTT
gttgtttcctctaactggaa

SEQ ID NO: 14904 - DNA, 20 bp, Artificial Sequence
  Description of Artificial Sequence: Synthetic oligonucleotide
  Target: ANGPTL3; (+) strand; PAM type: YTN; PAM sequence: TTG
ttgtttcctctaactggaac

SEQ ID NO: 14905 - DNA, 20 bp, Artificial Sequence
  Description of Artificial Sequence: Synthetic oligonucleotide
  Target: ANGPTL3; (+) strand; PAM type: YTN; PAM sequence: TTG
tttcctctaactggaacgct

SEQ ID NO: 14906 - DNA, 20 bp, Artificial Sequence
  Description of Artificial Sequence: Synthetic oligonucleotide
  Target: ANGPTL3; (+) strand; PAM type: YTN; PAM sequence: TTT
cctctaactggaacgctctt

SEQ ID NO: 14907 - DNA, 20 bp, Artificial Sequence
  Description of Artificial Sequence: Synthetic oligonucleotide
  Target: ANGPTL3; (+) strand; PAM type: YTN; PAM sequence: TTC
ctctaactggaacgctcttc

SEQ ID NO: 14908 - DNA, 20 bp, Artificial Sequence
  Description of Artificial Sequence: Synthetic oligonucleotide
  Target: ANGPTL3; (+) strand; PAM type: YTN; PAM sequence: CTC
taactggaacgctcttctgc

SEQ ID NO: 14909 - DNA, 20 bp, Artificial Sequence
  Description of Artificial Sequence: Synthetic oligonucleotide
  Target: ANGPTL3; (+) strand; PAM type: YTN; PAM sequence: CTA
actggaacgctcttctgccc

SEQ ID NO: 14910 - DNA, 20 bp, Artificial Sequence
  Description of Artificial Sequence: Synthetic oligonucleotide
  Target: ANGPTL3; (+) strand; PAM type: YTN; PAM sequence: CTG
gaacgctcttctgccctggt

SEQ ID NO: 14911 - DNA, 20 bp, Artificial Sequence
  Description of Artificial Sequence: Synthetic oligonucleotide
  Target: ANGPTL3; (+) strand; PAM type: YTN; PAM sequence: CTC
ttctgccctggtatctacgt

SEQ ID NO: 14912 - DNA, 20 bp, Artificial Sequence
  Description of Artificial Sequence: Synthetic oligonucleotide
  Target: ANGPTL3; (+) strand; PAM type: YTN; PAM sequence: CTT
ctgccctggtatctacgtgg

SEQ ID NO: 14913 - DNA, 20 bp, Artificial Sequence
  Description of Artificial Sequence: Synthetic oligonucleotide
  Target: ANGPTL3; (+) strand; PAM type: YTN; PAM sequence: TTC
tgccctggtatctacgtggc

SEQ ID NO: 14914 - DNA, 20 bp, Artificial Sequence
  Description of Artificial Sequence: Synthetic oligonucleotide
  Target: ANGPTL3; (+) strand; PAM type: YTN; PAM sequence: CTG
ccctggtatctacgtggccc

SEQ ID NO: 14915 - DNA, 20 bp, Artificial Sequence
  Description of Artificial Sequence: Synthetic oligonucleotide
  Target: ANGPTL3; (+) strand; PAM type: YTN; PAM sequence: CTG
gtatctacgtggcccactct

SEQ ID NO: 14916 - DNA, 20 bp, Artificial Sequence
  Description of Artificial Sequence: Synthetic oligonucleotide
  Target: ANGPTL3; (+) strand; PAM type: YTN; PAM sequence: CTA
cgtggcccactctctgattt

SEQ ID NO: 14917 - DNA, 20 bp, Artificial Sequence
  Description of Artificial Sequence: Synthetic oligonucleotide
  Target: ANGPTL3; (+) strand; PAM type: YTN; PAM sequence: CTC
tctgatttcccttagggtcg

SEQ ID NO: 14918 - DNA, 20 bp, Artificial Sequence
  Description of Artificial Sequence: Synthetic oligonucleotide
  Target: ANGPTL3; (+) strand; PAM type: YTN; PAM sequence: CTC
tgatttcccttagggtcgtt

SEQ ID NO: 14919 - DNA, 20 bp, Artificial Sequence
  Description of Artificial Sequence: Synthetic oligonucleotide
  Target: ANGPTL3; (+) strand; PAM type: YTN; PAM sequence: CTG
atttcccttagggtcgttat

SEQ ID NO: 14920 - DNA, 20 bp, Artificial Sequence
  Description of Artificial Sequence: Synthetic oligonucleotide
  Target: ANGPTL3; (+) strand; PAM type: YTN; PAM sequence: TTT
cccttagggtcgttatcaaa

SEQ ID NO: 14921 - DNA, 20 bp, Artificial Sequence
  Description of Artificial Sequence: Synthetic oligonucleotide
  Target: ANGPTL3; (+) strand; PAM type: YTN; PAM sequence: TTC
ccttagggtcgttatcaaac

SEQ ID NO: 14922 - DNA, 20 bp, Artificial Sequence
  Description of Artificial Sequence: Synthetic oligonucleotide
  Target: ANGPTL3; (+) strand; PAM type: YTN; PAM sequence: CTT
agggtcgttatcaaacaaaa

SEQ ID NO: 14923 - DNA, 20 bp, Artificial Sequence
  Description of Artificial Sequence: Synthetic oligonucleotide
  Target: ANGPTL3; (+) strand; PAM type: YTN; PAM sequence: TTA
gggtcgttatcaaacaaaaa

SEQ ID NO: 14924 - DNA, 20 bp, Artificial Sequence
  Description of Artificial Sequence: Synthetic oligonucleotide
  Target: ANGPTL3; (+) strand; PAM type: YTN; PAM sequence: TTA
tcaaacaaaaaattcccaat

SEQ ID NO: 14925 - DNA, 20 bp, Artificial Sequence
  Description of Artificial Sequence: Synthetic oligonucleotide
  Target: ANGPTL3; (+) strand; PAM type: YTN; PAM sequence: TTC
ccaatgaagacttacaaggt

SEQ ID NO: 14926 - DNA, 20 bp, Artificial Sequence
  Description of Artificial Sequence: Synthetic oligonucleotide
  Target: ANGPTL3; (+) strand; PAM type: YTN; PAM sequence: CTT
acaaggtcacttaaccaaaa

SEQ ID NO: 14927 - DNA, 20 bp, Artificial Sequence
  Description of Artificial Sequence: Synthetic oligonucleotide
  Target: ANGPTL3; (+) strand; PAM type: YTN; PAM sequence: TTA
caaggtcacttaaccaaaaa

SEQ ID NO: 14928 - DNA, 20 bp, Artificial Sequence
  Description of Artificial Sequence: Synthetic oligonucleotide
  Target: ANGPTL3; (+) strand; PAM type: YTN; PAM sequence: CTT
aaccaaaaatcacaaccgcc

SEQ ID NO: 14929 - DNA, 20 bp, Artificial Sequence
  Description of Artificial Sequence: Synthetic oligonucleotide
  Target: ANGPTL3; (+) strand; PAM type: YTN; PAM sequence: TTA
accaaaaatcacaaccgcct

SEQ ID NO: 14930 - DNA, 20 bp, Artificial Sequence
  Description of Artificial Sequence: Synthetic oligonucleotide
  Target: ANGPTL3; (+) strand; PAM type: YTN; PAM sequence: CTG
gtcccatccctgaaaacttc

SEQ ID NO: 14931 - DNA, 20 bp, Artificial Sequence
  Description of Artificial Sequence: Synthetic oligonucleotide
  Target: ANGPTL3; (+) strand; PAM type: YTN; PAM sequence: CTG
aaaacttctacttccttagc

SEQ ID NO: 14932 - DNA, 20 bp, Artificial Sequence
  Description of Artificial Sequence: Synthetic oligonucleotide
  Target: ANGPTL3; (+) strand; PAM type: YTN; PAM sequence: CTT
ctacttccttagctactttt

SEQ ID NO: 14933 - DNA, 20 bp, Artificial Sequence
  Description of Artificial Sequence: Synthetic oligonucleotide
  Target: ANGPTL3; (+) strand; PAM type: YTN; PAM sequence: TTC
tacttccttagctacttttc

SEQ ID NO: 14934 - DNA, 20 bp, Artificial Sequence
  Description of Artificial Sequence: Synthetic oligonucleotide
  Target: ANGPTL3; (+) strand; PAM type: YTN; PAM sequence: CTA
cttccttagctacttttctc

SEQ ID NO: 14935 - DNA, 20 bp, Artificial Sequence
  Description of Artificial Sequence: Synthetic oligonucleotide
  Target: ANGPTL3; (+) strand; PAM type: YTN; PAM sequence: CTT
ccttagctacttttctcctg

SEQ ID NO: 14936 - DNA, 20 bp, Artificial Sequence
  Description of Artificial Sequence: Synthetic oligonucleotide
  Target: ANGPTL3; (+) strand; PAM type: YTN; PAM sequence: TTC
cttagctacttttctcctgc

SEQ ID NO: 14937 - DNA, 20 bp, Artificial Sequence
  Description of Artificial Sequence: Synthetic oligonucleotide
  Target: ANGPTL3; (+) strand; PAM type: YTN; PAM sequence: CTT
agctacttttctcctgcaca

SEQ ID NO: 14938 - DNA, 20 bp, Artificial Sequence
  Description of Artificial Sequence: Synthetic oligonucleotide
  Target: ANGPTL3; (+) strand; PAM type: YTN; PAM sequence: TTA
gctacttttctcctgcacac

SEQ ID NO: 14939 - DNA, 20 bp, Artificial Sequence
  Description of Artificial Sequence: Synthetic oligonucleotide
  Target: ANGPTL3; (+) strand; PAM type: YTN; PAM sequence: CTA
cttttctcctgcacactcac

SEQ ID NO: 14940 - DNA, 20 bp, Artificial Sequence
  Description of Artificial Sequence: Synthetic oligonucleotide
  Target: ANGPTL3; (+) strand; PAM type: YTN; PAM sequence: CTT
ttctcctgcacactcacctt

SEQ ID NO: 14941 - DNA, 20 bp, Artificial Sequence
  Description of Artificial Sequence: Synthetic oligonucleotide
  Target: ANGPTL3; (+) strand; PAM type: YTN; PAM sequence: TTT
tctcctgcacactcaccttt

SEQ ID NO: 14942 - DNA, 20 bp, Artificial Sequence
  Description of Artificial Sequence: Synthetic oligonucleotide
  Target: ANGPTL3; (+) strand; PAM type: YTN; PAM sequence: TTT
ctcctgcacactcaccttta

SEQ ID NO: 14943 - DNA, 20 bp, Artificial Sequence
  Description of Artificial Sequence: Synthetic oligonucleotide
  Target: ANGPTL3; (+) strand; PAM type: YTN; PAM sequence: TTC
tcctgcacactcacctttat

SEQ ID NO: 14944 - DNA, 20 bp, Artificial Sequence
  Description of Artificial Sequence: Synthetic oligonucleotide
  Target: ANGPTL3; (+) strand; PAM type: YTN; PAM sequence: CTC
ctgcacactcacctttattt

SEQ ID NO: 14945 - DNA, 20 bp, Artificial Sequence
  Description of Artificial Sequence: Synthetic oligonucleotide
  Target: ANGPTL3; (+) strand; PAM type: YTN; PAM sequence: CTG
cacactcacctttatttaac

SEQ ID NO: 14946 - DNA, 20 bp, Artificial Sequence
  Description of Artificial Sequence: Synthetic oligonucleotide
  Target: ANGPTL3; (+) strand; PAM type: YTN; PAM sequence: CTC
acctttatttaacataacat

SEQ ID NO: 14947 - DNA, 20 bp, Artificial Sequence
  Description of Artificial Sequence: Synthetic oligonucleotide
  Target: ANGPTL3; (+) strand; PAM type: YTN; PAM sequence: CTT
tatttaacataacataaatt

SEQ ID NO: 14948 - DNA, 20 bp, Artificial Sequence
  Description of Artificial Sequence: Synthetic oligonucleotide
  Target: ANGPTL3; (+) strand; PAM type: YTN; PAM sequence: TTT
atttaacataacataaattt

SEQ ID NO: 14949 - DNA, 20 bp, Artificial Sequence
  Description of Artificial Sequence: Synthetic oligonucleotide
  Target: ANGPTL3; (+) strand; PAM type: YTN; PAM sequence: TTA
tttaacataacataaatttt

SEQ ID NO: 14950 - DNA, 20 bp, Artificial Sequence
  Description of Artificial Sequence: Synthetic oligonucleotide
  Target: ANGPTL3; (+) strand; PAM type: YTN; PAM sequence: TTT
aacataacataaattttagt

SEQ ID NO: 14951 - DNA, 20 bp, Artificial Sequence
  Description of Artificial Sequence: Synthetic oligonucleotide
  Target: ANGPTL3; (+) strand; PAM type: YTN; PAM sequence: TTA
acataacataaattttagtt

SEQ ID NO: 14952 - DNA, 20 bp, Artificial Sequence
  Description of Artificial Sequence: Synthetic oligonucleotide
  Target: ANGPTL3; (+) strand; PAM type: YTN; PAM sequence: TTT
tagttatttatctcttctat

SEQ ID NO: 14953 - DNA, 20 bp, Artificial Sequence
  Description of Artificial Sequence: Synthetic oligonucleotide
  Target: ANGPTL3; (+) strand; PAM type: YTN; PAM sequence: TTT
agttatttatctcttctatt

SEQ ID NO: 14954 - DNA, 20 bp, Artificial Sequence
  Description of Artificial Sequence: Synthetic oligonucleotide
  Target: ANGPTL3; (+) strand; PAM type: YTN; PAM sequence: TTA
gttatttatctcttctattc

SEQ ID NO: 14955 - DNA, 20 bp, Artificial Sequence
  Description of Artificial Sequence: Synthetic oligonucleotide
  Target: ANGPTL3; (+) strand; PAM type: YTN; PAM sequence: TTA
tttatctcttctattcctgc

SEQ ID NO: 14956 - DNA, 20 bp, Artificial Sequence
  Description of Artificial Sequence: Synthetic oligonucleotide
  Target: ANGPTL3; (+) strand; PAM type: YTN; PAM sequence: TTT
atctcttctattcctgcact

SEQ ID NO: 14957 - DNA, 20 bp, Artificial Sequence
  Description of Artificial Sequence: Synthetic oligonucleotide
  Target: ANGPTL3; (+) strand; PAM type: YTN; PAM sequence: TTA
tctcttctattcctgcacta

SEQ ID NO: 14958 - DNA, 20 bp, Artificial Sequence
  Description of Artificial Sequence: Synthetic oligonucleotide
  Target: ANGPTL3; (+) strand; PAM type: YTN; PAM sequence: CTC
ttctattcctgcactaaaat

SEQ ID NO: 14959 - DNA, 20 bp, Artificial Sequence
  Description of Artificial Sequence: Synthetic oligonucleotide
  Target: ANGPTL3; (+) strand; PAM type: YTN; PAM sequence: CTT
ctattcctgcactaaaatgt

SEQ ID NO: 14960 - DNA, 20 bp, Artificial Sequence
  Description of Artificial Sequence: Synthetic oligonucleotide
  Target: ANGPTL3; (+) strand; PAM type: YTN; PAM sequence: TTC
tattcctgcactaaaatgta

SEQ ID NO: 14961 - DNA, 20 bp, Artificial Sequence
  Description of Artificial Sequence: Synthetic oligonucleotide
  Target: ANGPTL3; (+) strand; PAM type: YTN; PAM sequence: CTA
ttcctgcactaaaatgtaag

SEQ ID NO: 14962 - DNA, 20 bp, Artificial Sequence
  Description of Artificial Sequence: Synthetic oligonucleotide
  Target: ANGPTL3; (+) strand; PAM type: YTN; PAM sequence: TTC
ctgcactaaaatgtaagctc

SEQ ID NO: 14963 - DNA, 20 bp, Artificial Sequence
  Description of Artificial Sequence: Synthetic oligonucleotide
  Target: ANGPTL3; (+) strand; PAM type: YTN; PAM sequence: CTG
cactaaaatgtaagctctgt

SEQ ID NO: 14964 - DNA, 20 bp, Artificial Sequence
  Description of Artificial Sequence: Synthetic oligonucleotide
  Target: ANGPTL3; (+) strand; PAM type: YTN; PAM sequence: CTA
aaatgtaagctctgtgaata

SEQ ID NO: 14965 - DNA, 20 bp, Artificial Sequence
  Description of Artificial Sequence: Synthetic oligonucleotide
  Target: ANGPTL3; (+) strand; PAM type: YTN; PAM sequence: CTC
tgtgaatacagggatttttt

SEQ ID NO: 14966 - DNA, 20 bp, Artificial Sequence
  Description of Artificial Sequence: Synthetic oligonucleotide
  Target: ANGPTL3; (+) strand; PAM type: YTN; PAM sequence: CTG
tgaatacagggattttttcc

SEQ ID NO: 14967 - DNA, 20 bp, Artificial Sequence
  Description of Artificial Sequence: Synthetic oligonucleotide
  Target: ANGPTL3; (+) strand; PAM type: YTN; PAM sequence: TTT
tttccattatcttcatattt

SEQ ID NO: 14968 - DNA, 20 bp, Artificial Sequence
  Description of Artificial Sequence: Synthetic oligonucleotide
  Target: ANGPTL3; (+) strand; PAM type: YTN; PAM sequence: TTT
ttccattatcttcatatttt

SEQ ID NO: 14969 - DNA, 20 bp, Artificial Sequence
  Description of Artificial Sequence: Synthetic oligonucleotide
  Target: ANGPTL3; (+) strand; PAM type: YTN; PAM sequence: TTT
tccattatcttcatattttc

SEQ ID NO: 14970 - DNA, 20 bp, Artificial Sequence
  Description of Artificial Sequence: Synthetic oligonucleotide
  Target: ANGPTL3; (+) strand; PAM type: YTN; PAM sequence: TTT
ccattatcttcatattttcc

SEQ ID NO: 14971 - DNA, 20 bp, Artificial Sequence
  Description of Artificial Sequence: Synthetic oligonucleotide
  Target: ANGPTL3; (+) strand; PAM type: YTN; PAM sequence: TTC
cattatcttcatattttcca

SEQ ID NO: 14972 - DNA, 20 bp, Artificial Sequence
  Description of Artificial Sequence: Synthetic oligonucleotide
  Target: ANGPTL3; (+) strand; PAM type: YTN; PAM sequence: TTA
tcttcatattttccattatt

SEQ ID NO: 14973 - DNA, 20 bp, Artificial Sequence
  Description of Artificial Sequence: Synthetic oligonucleotide
  Target: ANGPTL3; (+) strand; PAM type: YTN; PAM sequence: CTT
catattttccattatttgta

SEQ ID NO: 14974 - DNA, 20 bp, Artificial Sequence
  Description of Artificial Sequence: Synthetic oligonucleotide
  Target: ANGPTL3; (+) strand; PAM type: YTN; PAM sequence: TTC
atattttccattatttgtat

SEQ ID NO: 14975 - DNA, 20 bp, Artificial Sequence
  Description of Artificial Sequence: Synthetic oligonucleotide
  Target: ANGPTL3; (+) strand; PAM type: YTN; PAM sequence: TTT
tccattatttgtatatactc

SEQ ID NO: 14976 - DNA, 20 bp, Artificial Sequence
  Description of Artificial Sequence: Synthetic oligonucleotide
  Target: ANGPTL3; (+) strand; PAM type: YTN; PAM sequence: TTT
ccattatttgtatatactcc

SEQ ID NO: 14977 - DNA, 20 bp, Artificial Sequence
  Description of Artificial Sequence: Synthetic oligonucleotide
  Target: ANGPTL3; (+) strand; PAM type: YTN; PAM sequence: TTC
cattatttgtatatactcca

SEQ ID NO: 14978 - DNA, 20 bp, Artificial Sequence
  Description of Artificial Sequence: Synthetic oligonucleotide
  Target: ANGPTL3; (+) strand; PAM type: YTN; PAM sequence: TTA
tttgtatatactccagaata

SEQ ID NO: 14979 - DNA, 20 bp, Artificial Sequence
  Description of Artificial Sequence: Synthetic oligonucleotide
  Target: ANGPTL3; (+) strand; PAM type: YTN; PAM sequence: TTT
gtatatactccagaatatag

SEQ ID NO: 14980 - DNA, 20 bp, Artificial Sequence
  Description of Artificial Sequence: Synthetic oligonucleotide
  Target: ANGPTL3; (+) strand; PAM type: YTN; PAM sequence: TTG
tatatactccagaatataga

SEQ ID NO: 14981 - DNA, 20 bp, Artificial Sequence
  Description of Artificial Sequence: Synthetic oligonucleotide
  Target: ANGPTL3; (+) strand; PAM type: YTN; PAM sequence: CTC
cagaatatagaatactgtat

SEQ ID NO: 14982 - DNA, 20 bp, Artificial Sequence
  Description of Artificial Sequence: Synthetic oligonucleotide
  Target: ANGPTL3; (+) strand; PAM type: YTN; PAM sequence: CTG
tatggcacacagtaggcatt

SEQ ID NO: 14983 - DNA, 20 bp, Artificial Sequence
  Description of Artificial Sequence: Synthetic oligonucleotide
  Target: ANGPTL3; (+) strand; PAM type: YTN; PAM sequence: TTT
ctgttgaattaataaatgta

SEQ ID NO: 14984 - DNA, 20 bp, Artificial Sequence
  Description of Artificial Sequence: Synthetic oligonucleotide
  Target: ANGPTL3; (+) strand; PAM type: YTN; PAM sequence: TTC
tgttgaattaataaatgtaa

SEQ ID NO: 14985 - DNA, 20 bp, Artificial Sequence
  Description of Artificial Sequence: Synthetic oligonucleotide
  Target: ANGPTL3; (+) strand; PAM type: YTN; PAM sequence: CTG
ttgaattaataaatgtaatg

SEQ ID NO: 14986 - DNA, 20 bp, Artificial Sequence
  Description of Artificial Sequence: Synthetic oligonucleotide
  Target: ANGPTL3; (+) strand; PAM type: YTN; PAM sequence: TTG
aattaataaatgtaatgtca

SEQ ID NO: 14987 - DNA, 20 bp, Artificial Sequence
  Description of Artificial Sequence: Synthetic oligonucleotide
  Target: ANGPTL3; (+) strand; PAM type: YTN; PAM sequence: TTA
ataaatgtaatgtcatattc

SEQ ID NO: 14988 - DNA, 20 bp, Artificial Sequence
  Description of Artificial Sequence: Synthetic oligonucleotide
  Target: ANGPTL3; (+) strand; PAM type: YTN; PAM sequence: TTC
acacagaagcgtgtgctatg

SEQ ID NO: 14989 - DNA, 20 bp, Artificial Sequence
  Description of Artificial Sequence: Synthetic oligonucleotide
  Target: ANGPTL3; (+) strand; PAM type: YTN; PAM sequence: CTA
tgattattattacttggatt

SEQ ID NO: 14990 - DNA, 20 bp, Artificial Sequence
  Description of Artificial Sequence: Synthetic oligonucleotide
  Target: ANGPTL3; (+) strand; PAM type: YTN; PAM sequence: TTA
ttattacttggattactaga

SEQ ID NO: 14991 - DNA, 20 bp, Artificial Sequence
  Description of Artificial Sequence: Synthetic oligonucleotide
  Target: ANGPTL3; (+) strand; PAM type: YTN; PAM sequence: TTA
ttacttggattactagaaat

SEQ ID NO: 14992 - DNA, 20 bp, Artificial Sequence
  Description of Artificial Sequence: Synthetic oligonucleotide
  Target: ANGPTL3; (+) strand; PAM type: YTN; PAM sequence: TTA
cttggattactagaaatagt

SEQ ID NO: 14993 - DNA, 20 bp, Artificial Sequence
  Description of Artificial Sequence: Synthetic oligonucleotide
  Target: ANGPTL3; (+) strand; PAM type: YTN; PAM sequence: CTT
ggattactagaaatagtgtg

SEQ ID NO: 14994 - DNA, 20 bp, Artificial Sequence
  Description of Artificial Sequence: Synthetic oligonucleotide
  Target: ANGPTL3; (+) strand; PAM type: YTN; PAM sequence: TTG
gattactagaaatagtgtgc

SEQ ID NO: 14995 - DNA, 20 bp, Artificial Sequence
  Description of Artificial Sequence: Synthetic oligonucleotide
  Target: ANGPTL3; (+) strand; PAM type: YTN; PAM sequence: TTA
ctagaaatagtgtgcctcat

SEQ ID NO: 14996 - DNA, 20 bp, Artificial Sequence
  Description of Artificial Sequence: Synthetic oligonucleotide
  Target: ANGPTL3; (+) strand; PAM type: YTN; PAM sequence: CTA
gaaatagtgtgcctcataat

SEQ ID NO: 14997 - DNA, 20 bp, Artificial Sequence
  Description of Artificial Sequence: Synthetic oligonucleotide
  Target: ANGPTL3; (+) strand; PAM type: YTN; PAM sequence: CTC
ataattaaaggtcaacattc

SEQ ID NO: 14998 - DNA, 20 bp, Artificial Sequence
  Description of Artificial Sequence: Synthetic oligonucleotide
  Target: ANGPTL3; (+) strand; PAM type: YTN; PAM sequence: TTA
aaggtcaacattcaacaatg

SEQ ID NO: 14999 - DNA, 20 bp, Artificial Sequence
  Description of Artificial Sequence: Synthetic oligonucleotide
  Target: ANGPTL3; (+) strand; PAM type: YTN; PAM sequence: TTC
aacaatgtaattaatctaca

SEQ ID NO: 15000 - DNA, 20 bp, Artificial Sequence
  Description of Artificial Sequence: Synthetic oligonucleotide
  Target: ANGPTL3; (+) strand; PAM type: YTN; PAM sequence: TTA
atctacaatgtaaacatctg

SEQ ID NO: 15001 - DNA, 20 bp, Artificial Sequence
  Description of Artificial Sequence: Synthetic oligonucleotide
  Target: ANGPTL3; (+) strand; PAM type: YTN; PAM sequence: CTA
caatgtaaacatctggtgaa

SEQ ID NO: 15002 - DNA, 20 bp, Artificial Sequence
  Description of Artificial Sequence: Synthetic oligonucleotide
  Target: ANGPTL3; (+) strand; PAM type: YTN; PAM sequence: CTG
gtgaagtgacagagggaagc

SEQ ID NO: 15003 - DNA, 20 bp, Artificial Sequence
  Description of Artificial Sequence: Synthetic oligonucleotide
  Target: ANGPTL3; (+) strand; PAM type: YTN; PAM sequence: CTT
gtttagaaaaaagctatgtc

SEQ ID NO: 15004 - DNA, 20 bp, Artificial Sequence
  Description of Artificial Sequence: Synthetic oligonucleotide
  Target: ANGPTL3; (+) strand; PAM type: YTN; PAM sequence: TTG
tttagaaaaaagctatgtca

SEQ ID NO: 15005 - DNA, 20 bp, Artificial Sequence
  Description of Artificial Sequence: Synthetic oligonucleotide
  Target: ANGPTL3; (+) strand; PAM type: YTN; PAM sequence: TTT
agaaaaaagctatgtcagaa

SEQ ID NO: 15006 - DNA, 20 bp, Artificial Sequence
  Description of Artificial Sequence: Synthetic oligonucleotide
  Target: ANGPTL3; (+) strand; PAM type: YTN; PAM sequence: TTA
gaaaaaagctatgtcagaat

SEQ ID NO: 15007 - DNA, 20 bp, Artificial Sequence
  Description of Artificial Sequence: Synthetic oligonucleotide
  Target: ANGPTL3; (+) strand; PAM type: YTN; PAM sequence: CTA
tgtcagaatccatgtattct

SEQ ID NO: 15008 - DNA, 20 bp, Artificial Sequence
  Description of Artificial Sequence: Synthetic oligonucleotide
  Target: ANGPTL3; (+) strand; PAM type: YTN; PAM sequence: TTC
taatatgcagtacaatagtt

SEQ ID NO: 15009 - DNA, 20 bp, Artificial Sequence
  Description of Artificial Sequence: Synthetic oligonucleotide
  Target: ANGPTL3; (+) strand; PAM type: YTN; PAM sequence: CTA
atatgcagtacaatagttta

SEQ ID NO: 15010 - DNA, 20 bp, Artificial Sequence
  Description of Artificial Sequence: Synthetic oligonucleotide
  Target: ANGPTL3; (+) strand; PAM type: YTN; PAM sequence: TTT
aaaaatattaataatactct

SEQ ID NO: 15011 - DNA, 20 bp, Artificial Sequence
  Description of Artificial Sequence: Synthetic oligonucleotide
  Target: ANGPTL3; (+) strand; PAM type: YTN; PAM sequence: TTA
aaaatattaataatactctc

SEQ ID NO: 15012 - DNA, 20 bp, Artificial Sequence
  Description of Artificial Sequence: Synthetic oligonucleotide
  Target: ANGPTL3; (+) strand; PAM type: YTN; PAM sequence: TTA
ataatactctcaaacagcta

SEQ ID NO: 15013 - DNA, 20 bp, Artificial Sequence
  Description of Artificial Sequence: Synthetic oligonucleotide
  Target: ANGPTL3; (+) strand; PAM type: YTN; PAM sequence: CTC
tcaaacagctattcaagagg

SEQ ID NO: 15014 - DNA, 20 bp, Artificial Sequence
  Description of Artificial Sequence: Synthetic oligonucleotide
  Target: ANGPTL3; (+) strand; PAM type: YTN; PAM sequence: CTC
aaacagctattcaagaggat

SEQ ID NO: 15015 - DNA, 20 bp, Artificial Sequence
  Description of Artificial Sequence: Synthetic oligonucleotide
  Target: ANGPTL3; (+) strand; PAM type: YTN; PAM sequence: CTA
ttcaagaggattcaaaaaac

SEQ ID NO: 15016 - DNA, 20 bp, Artificial Sequence
  Description of Artificial Sequence: Synthetic oligonucleotide
  Target: ANGPTL3; (+) strand; PAM type: YTN; PAM sequence: TTC
aagaggattcaaaaaacata

SEQ ID NO: 15017 - DNA, 20 bp, Artificial Sequence
  Description of Artificial Sequence: Synthetic oligonucleotide
  Target: ANGPTL3; (+) strand; PAM type: YTN; PAM sequence: TTC
aaaaaacataatataaactc

SEQ ID NO: 15018 - DNA, 20 bp, Artificial Sequence
  Description of Artificial Sequence: Synthetic oligonucleotide
  Target: ANGPTL3; (+) strand; PAM type: YTN; PAM sequence: CTC
agagaaactggtaaacaaaa

SEQ ID NO: 15019 - DNA, 20 bp, Artificial Sequence
  Description of Artificial Sequence: Synthetic oligonucleotide
  Target: ANGPTL3; (+) strand; PAM type: YTN; PAM sequence: CTG
gtaaacaaaatcattttcaa

SEQ ID NO: 15020 - DNA, 20 bp, Artificial Sequence
  Description of Artificial Sequence: Synthetic oligonucleotide
  Target: ANGPTL3; (+) strand; PAM type: YTN; PAM sequence: TTT
tcaagagatataaaacaaat

SEQ ID NO: 15021 - DNA, 20 bp, Artificial Sequence
  Description of Artificial Sequence: Synthetic oligonucleotide
  Target: ANGPTL3; (+) strand; PAM type: YTN; PAM sequence: TTT
caagagatataaaacaaata

SEQ ID NO: 15022 - DNA, 20 bp, Artificial Sequence
  Description of Artificial Sequence: Synthetic oligonucleotide
  Target: ANGPTL3; (+) strand; PAM type: YTN; PAM sequence: TTC
aagagatataaaacaaatat

SEQ ID NO: 15023 - DNA, 20 bp, Artificial Sequence
  Description of Artificial Sequence: Synthetic oligonucleotide
  Target: ANGPTL3; (+) strand; PAM type: YTN; PAM sequence: TTA
ttaccaatttccactaaaca

SEQ ID NO: 15024 - DNA, 20 bp, Artificial Sequence
  Description of Artificial Sequence: Synthetic oligonucleotide
  Target: ANGPTL3; (+) strand; PAM type: YTN; PAM sequence: TTA
ccaatttccactaaacaaac

SEQ ID NO: 15025 - DNA, 20 bp, Artificial Sequence
  Description of Artificial Sequence: Synthetic oligonucleotide
  Target: ANGPTL3; (+) strand; PAM type: YTN; PAM sequence: TTT
ccactaaacaaacataatgt

SEQ ID NO: 15026 - DNA, 20 bp, Artificial Sequence
  Description of Artificial Sequence: Synthetic oligonucleotide
  Target: ANGPTL3; (+) strand; PAM type: YTN; PAM sequence: TTC
cactaaacaaacataatgtt

SEQ ID NO: 15027 - DNA, 20 bp, Artificial Sequence
  Description of Artificial Sequence: Synthetic oligonucleotide
  Target: ANGPTL3; (+) strand; PAM type: YTN; PAM sequence: CTA
aacaaacataatgttagtag

SEQ ID NO: 15028 - DNA, 20 bp, Artificial Sequence
  Description of Artificial Sequence: Synthetic oligonucleotide
  Target: ANGPTL3; (+) strand; PAM type: YTN; PAM sequence: TTA
gtagtgctgctaaaaggttt

SEQ ID NO: 15029 - DNA, 20 bp, Artificial Sequence
  Description of Artificial Sequence: Synthetic oligonucleotide
  Target: ANGPTL3; (+) strand; PAM type: YTN; PAM sequence: CTG
ctaaaaggttttttatcaac

SEQ ID NO: 15030 - DNA, 20 bp, Artificial Sequence
  Description of Artificial Sequence: Synthetic oligonucleotide
  Target: ANGPTL3; (+) strand; PAM type: YTN; PAM sequence: CTA
aaaggttttttatcaactac

SEQ ID NO: 15031 - DNA, 20 bp, Artificial Sequence
  Description of Artificial Sequence: Synthetic oligonucleotide
  Target: ANGPTL3; (+) strand; PAM type: YTN; PAM sequence: TTT
tttatcaactacttttggtt

SEQ ID NO: 15032 - DNA, 20 bp, Artificial Sequence
  Description of Artificial Sequence: Synthetic oligonucleotide
  Target: ANGPTL3; (+) strand; PAM type: YTN; PAM sequence: TTT
ttatcaactacttttggttt

SEQ ID NO: 15033 - DNA, 20 bp, Artificial Sequence
  Description of Artificial Sequence: Synthetic oligonucleotide
  Target: ANGPTL3; (+) strand; PAM type: YTN; PAM sequence: TTT
tatcaactacttttggtttc

SEQ ID NO: 15034 - DNA, 20 bp, Artificial Sequence
  Description of Artificial Sequence: Synthetic oligonucleotide
  Target: ANGPTL3; (+) strand; PAM type: YTN; PAM sequence: TTT
atcaactacttttggtttcc

SEQ ID NO: 15035 - DNA, 20 bp, Artificial Sequence
  Description of Artificial Sequence: Synthetic oligonucleotide
  Target: ANGPTL3; (+) strand; PAM type: YTN; PAM sequence: TTA
tcaactacttttggtttcca

SEQ ID NO: 15036 - DNA, 20 bp, Artificial Sequence
  Description of Artificial Sequence: Synthetic oligonucleotide
  Target: ANGPTL3; (+) strand; PAM type: YTN; PAM sequence: CTA
cttttggtttccatactttc

SEQ ID NO: 15037 - DNA, 20 bp, Artificial Sequence
  Description of Artificial Sequence: Synthetic oligonucleotide
  Target: ANGPTL3; (+) strand; PAM type: YTN; PAM sequence: CTT
ttggtttccatactttcctt

SEQ ID NO: 15038 - DNA, 20 bp, Artificial Sequence
  Description of Artificial Sequence: Synthetic oligonucleotide
  Target: ANGPTL3; (+) strand; PAM type: YTN; PAM sequence: TTT
tggtttccatactttccttc

SEQ ID NO: 15039 - DNA, 20 bp, Artificial Sequence
  Description of Artificial Sequence: Synthetic oligonucleotide
  Target: ANGPTL3; (+) strand; PAM type: YTN; PAM sequence: TTT
ggtttccatactttccttct

SEQ ID NO: 15040 - DNA, 20 bp, Artificial Sequence
  Description of Artificial Sequence: Synthetic oligonucleotide
  Target: ANGPTL3; (+) strand; PAM type: YTN; PAM sequence: TTG
gtttccatactttccttctt

SEQ ID NO: 15041 - DNA, 20 bp, Artificial Sequence
  Description of Artificial Sequence: Synthetic oligonucleotide
  Target: ANGPTL3; (+) strand; PAM type: YTN; PAM sequence: TTT
ccatactttccttcttatga

SEQ ID NO: 15042 - DNA, 20 bp, Artificial Sequence
  Description of Artificial Sequence: Synthetic oligonucleotide
  Target: ANGPTL3; (+) strand; PAM type: YTN; PAM sequence: TTC
catactttccttcttatgat

SEQ ID NO: 15043 - DNA, 20 bp, Artificial Sequence
  Description of Artificial Sequence: Synthetic oligonucleotide
  Target: ANGPTL3; (+) strand; PAM type: YTN; PAM sequence: CTT
tccttcttatgatgttatta

SEQ ID NO: 15044 - DNA, 20 bp, Artificial Sequence
  Description of Artificial Sequence: Synthetic oligonucleotide
  Target: ANGPTL3; (+) strand; PAM type: YTN; PAM sequence: TTT
ccttcttatgatgttattat

SEQ ID NO: 15045 - DNA, 20 bp, Artificial Sequence
  Description of Artificial Sequence: Synthetic oligonucleotide
  Target: ANGPTL3; (+) strand; PAM type: YTN; PAM sequence: TTC
cttcttatgatgttattatt

SEQ ID NO: 15046 - DNA, 20 bp, Artificial Sequence
  Description of Artificial Sequence: Synthetic oligonucleotide
  Target: ANGPTL3; (+) strand; PAM type: YTN; PAM sequence: CTT
cttatgatgttattattcta

SEQ ID NO: 15047 - DNA, 20 bp, Artificial Sequence
  Description of Artificial Sequence: Synthetic oligonucleotide
  Target: ANGPTL3; (+) strand; PAM type: YTN; PAM sequence: TTC
ttatgatgttattattctaa

SEQ ID NO: 15048 - DNA, 20 bp, Artificial Sequence
  Description of Artificial Sequence: Synthetic oligonucleotide
  Target: ANGPTL3; (+) strand; PAM type: YTN; PAM sequence: CTT
atgatgttattattctaaat

SEQ ID NO: 15049 - DNA, 20 bp, Artificial Sequence
  Description of Artificial Sequence: Synthetic oligonucleotide
  Target: ANGPTL3; (+) strand; PAM type: YTN; PAM sequence: TTA
tgatgttattattctaaatt

SEQ ID NO: 15050 - DNA, 20 bp, Artificial Sequence
  Description of Artificial Sequence: Synthetic oligonucleotide
  Target: ANGPTL3; (+) strand; PAM type: YTN; PAM sequence: TTA
ttattctaaattcttttcaa

SEQ ID NO: 15051 - DNA, 20 bp, Artificial Sequence
  Description of Artificial Sequence: Synthetic oligonucleotide
  Target: ANGPTL3; (+) strand; PAM type: YTN; PAM sequence: TTA
ttctaaattcttttcaatta

SEQ ID NO: 15052 - DNA, 20 bp, Artificial Sequence
  Description of Artificial Sequence: Synthetic oligonucleotide
  Target: ANGPTL3; (+) strand; PAM type: YTN; PAM sequence: TTC
taaattcttttcaattatat

SEQ ID NO: 15053 - DNA, 20 bp, Artificial Sequence
  Description of Artificial Sequence: Synthetic oligonucleotide
  Target: ANGPTL3; (+) strand; PAM type: YTN; PAM sequence: CTA
aattcttttcaattatatct

SEQ ID NO: 15054 - DNA, 20 bp, Artificial Sequence
  Description of Artificial Sequence: Synthetic oligonucleotide
  Target: ANGPTL3; (+) strand; PAM type: YTN; PAM sequence: TTC
ttttcaattatatcttttac

SEQ ID NO: 15055 - DNA, 20 bp, Artificial Sequence
  Description of Artificial Sequence: Synthetic oligonucleotide
  Target: ANGPTL3; (+) strand; PAM type: YTN; PAM sequence: CTT
ttcaattatatcttttacta

SEQ ID NO: 15056 - DNA, 20 bp, Artificial Sequence
  Description of Artificial Sequence: Synthetic oligonucleotide
  Target: ANGPTL3; (+) strand; PAM type: YTN; PAM sequence: TTT
tcaattatatcttttactat

SEQ ID NO: 15057 - DNA, 20 bp, Artificial Sequence
  Description of Artificial Sequence: Synthetic oligonucleotide
  Target: ANGPTL3; (+) strand; PAM type: YTN; PAM sequence: TTT
caattatatcttttactatg

SEQ ID NO: 15058 - DNA, 20 bp, Artificial Sequence
  Description of Artificial Sequence: Synthetic oligonucleotide
  Target: ANGPTL3; (+) strand; PAM type: YTN; PAM sequence: TTC
aattatatcttttactatga

SEQ ID NO: 15059 - DNA, 20 bp, Artificial Sequence
  Description of Artificial Sequence: Synthetic oligonucleotide
  Target: ANGPTL3; (+) strand; PAM type: YTN; PAM sequence: TTA
tatcttttactatgattaaa

SEQ ID NO: 15060 - DNA, 20 bp, Artificial Sequence
  Description of Artificial Sequence: Synthetic oligonucleotide
  Target: ANGPTL3; (+) strand; PAM type: YTN; PAM sequence: CTT
ttactatgattaaatgaacc

SEQ ID NO: 15061 - DNA, 20 bp, Artificial Sequence
  Description of Artificial Sequence: Synthetic oligonucleotide
  Target: ANGPTL3; (+) strand; PAM type: YTN; PAM sequence: TTT
tactatgattaaatgaacct

SEQ ID NO: 15062 - DNA, 20 bp, Artificial Sequence
  Description of Artificial Sequence: Synthetic oligonucleotide
  Target: ANGPTL3; (+) strand; PAM type: YTN; PAM sequence: TTT
actatgattaaatgaacctg

SEQ ID NO: 15063 - DNA, 20 bp, Artificial Sequence
  Description of Artificial Sequence: Synthetic oligonucleotide
  Target: ANGPTL3; (+) strand; PAM type: YTN; PAM sequence: TTA
ctatgattaaatgaacctgc

SEQ ID NO: 15064 - DNA, 20 bp, Artificial Sequence
  Description of Artificial Sequence: Synthetic oligonucleotide
  Target: ANGPTL3; (+) strand; PAM type: YTN; PAM sequence: CTA
tgattaaatgaacctgctcc

SEQ ID NO: 15065 - DNA, 20 bp, Artificial Sequence
  Description of Artificial Sequence: Synthetic oligonucleotide
  Target: ANGPTL3; (+) strand; PAM type: YTN; PAM sequence: TTA
aatgaacctgctccccaaag

SEQ ID NO: 15066 - DNA, 20 bp, Artificial Sequence
  Description of Artificial Sequence: Synthetic oligonucleotide
  Target: ANGPTL3; (+) strand; PAM type: YTN; PAM sequence: CTG
ctccccaaagcaaaatgtta

SEQ ID NO: 15067 - DNA, 20 bp, Artificial Sequence
  Description of Artificial Sequence: Synthetic oligonucleotide
  Target: ANGPTL3; (+) strand; PAM type: YTN; PAM sequence: CTC
cccaaagcaaaatgttacta

SEQ ID NO: 15068 - DNA, 20 bp, Artificial Sequence
  Description of Artificial Sequence: Synthetic oligonucleotide
  Target: ANGPTL3; (+) strand; PAM type: YTN; PAM sequence: TTA
ctatagtaatatacattgtg

SEQ ID NO: 15069 - DNA, 20 bp, Artificial Sequence
  Description of Artificial Sequence: Synthetic oligonucleotide
  Target: ANGPTL3; (+) strand; PAM type: YTN; PAM sequence: CTA
tagtaatatacattgtgtct

SEQ ID NO: 15070 - DNA, 20 bp, Artificial Sequence
  Description of Artificial Sequence: Synthetic oligonucleotide
  Target: ANGPTL3; (+) strand; PAM type: YTN; PAM sequence: TTG
tgtctaaaaataaaaatgtg

SEQ ID NO: 15071 - DNA, 20 bp, Artificial Sequence
  Description of Artificial Sequence: Synthetic oligonucleotide
  Target: ANGPTL3; (+) strand; PAM type: YTN; PAM sequence: CTA
aaaataaaaatgtgtgaaga

SEQ ID NO: 15072 - DNA, 20 bp, Artificial Sequence
  Description of Artificial Sequence: Synthetic oligonucleotide
  Target: ANGPTL3; (+) strand; PAM type: YTN; PAM sequence: TTT
ctgagttggaagaagagtta

SEQ ID NO: 15073 - DNA, 20 bp, Artificial Sequence
  Description of Artificial Sequence: Synthetic oligonucleotide
  Target: ANGPTL3; (+) strand; PAM type: YTN; PAM sequence: TTC
tgagttggaagaagagttag

SEQ ID NO: 15074 - DNA, 20 bp, Artificial Sequence
  Description of Artificial Sequence: Synthetic oligonucleotide
  Target: ANGPTL3; (+) strand; PAM type: YTN; PAM sequence: CTG
agttggaagaagagttagat

SEQ ID NO: 15075 - DNA, 20 bp, Artificial Sequence
  Description of Artificial Sequence: Synthetic oligonucleotide
  Target: ANGPTL3; (+) strand; PAM type: YTN; PAM sequence: TTG
gaagaagagttagatcattt

SEQ ID NO: 15076 - DNA, 20 bp, Artificial Sequence
  Description of Artificial Sequence: Synthetic oligonucleotide
  Target: ANGPTL3; (+) strand; PAM type: YTN; PAM sequence: TTA
gatcatttaactttctcata

SEQ ID NO: 15077 - DNA, 20 bp, Artificial Sequence
  Description of Artificial Sequence: Synthetic oligonucleotide
  Target: ANGPTL3; (+) strand; PAM type: YTN; PAM sequence: TTT
aactttctcatatttaaatt

SEQ ID NO: 15078 - DNA, 20 bp, Artificial Sequence
  Description of Artificial Sequence: Synthetic oligonucleotide
  Target: ANGPTL3; (+) strand; PAM type: YTN; PAM sequence: TTA
actttctcatatttaaatta

SEQ ID NO: 15079 - DNA, 20 bp, Artificial Sequence
  Description of Artificial Sequence: Synthetic oligonucleotide
  Target: ANGPTL3; (+) strand; PAM type: YTN; PAM sequence: CTT
tctcatatttaaattaaaaa

SEQ ID NO: 15080 - DNA, 20 bp, Artificial Sequence
  Description of Artificial Sequence: Synthetic oligonucleotide
  Target: ANGPTL3; (+) strand; PAM type: YTN; PAM sequence: TTT
ctcatatttaaattaaaaaa

SEQ ID NO: 15081 - DNA, 20 bp, Artificial Sequence
  Description of Artificial Sequence: Synthetic oligonucleotide
  Target: ANGPTL3; (+) strand; PAM type: YTN; PAM sequence: TTC
tcatatttaaattaaaaaaa

SEQ ID NO: 15082 - DNA, 20 bp, Artificial Sequence
  Description of Artificial Sequence: Synthetic oligonucleotide
  Target: ANGPTL3; (+) strand; PAM type: YTN; PAM sequence: CTC
atatttaaattaaaaaaaca

SEQ ID NO: 15083 - DNA, 20 bp, Artificial Sequence
  Description of Artificial Sequence: Synthetic oligonucleotide
  Target: ANGPTL3; (+) strand; PAM type: YTN; PAM sequence: TTT
aaattaaaaaaacaaaactc

SEQ ID NO: 15084 - DNA, 20 bp, Artificial Sequence
  Description of Artificial Sequence: Synthetic oligonucleotide
  Target: ANGPTL3; (+) strand; PAM type: YTN; PAM sequence: TTA
aattaaaaaaacaaaactct

SEQ ID NO: 15085 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaacaaaactctaaaaa

SEQ ID NO: 15086 - DNA, 20 bp, Artificial Sequence
  Description of Artificial Sequence: Synthetic oligonucleotide
  Target: ANGPTL3; (+) strand; PAM type: YTN; PAM sequence: CTC
taaaaatttaagtaacttta

SEQ ID NO: 15087 - DNA, 20 bp, Artificial Sequence
  Description of Artificial Sequence: Synthetic oligonucleotide
  Target: ANGPTL3; (+) strand; PAM type: YTN; PAM sequence: CTA
aaaatttaagtaactttaag

SEQ ID NO: 15088 - DNA, 20 bp, Artificial Sequence
  Description of Artificial Sequence: Synthetic oligonucleotide
  Target: ANGPTL3; (+) strand; PAM type: YTN; PAM sequence: TTT
aagtaactttaagatcacat

SEQ ID NO: 15089 - DNA, 20 bp, Artificial Sequence
  Description of Artificial Sequence: Synthetic oligonucleotide
  Target: ANGPTL3; (+) strand; PAM type: YTN; PAM sequence: TTA
agtaactttaagatcacata

SEQ ID NO: 15090 - DNA, 20 bp, Artificial Sequence
  Description of Artificial Sequence: Synthetic oligonucleotide
  Target: ANGPTL3; (+) strand; PAM type: YTN; PAM sequence: CTT
taagatcacatagttactta

SEQ ID NO: 15091 - DNA, 20 bp, Artificial Sequence
  Description of Artificial Sequence: Synthetic oligonucleotide
  Target: ANGPTL3; (+) strand; PAM type: YTN; PAM sequence: TTT
aagatcacatagttacttag

SEQ ID NO: 15092 - DNA, 20 bp, Artificial Sequence
  Description of Artificial Sequence: Synthetic oligonucleotide
  Target: ANGPTL3; (+) strand; PAM type: YTN; PAM sequence: TTA
agatcacatagttacttagt

SEQ ID NO: 15093 - DNA, 20 bp, Artificial Sequence
  Description of Artificial Sequence: Synthetic oligonucleotide
  Target: ANGPTL3; (+) strand; PAM type: YTN; PAM sequence: TTA
cttagtagaaaagagtaata

SEQ ID NO: 15094 - DNA, 20 bp, Artificial Sequence
  Description of Artificial Sequence: Synthetic oligonucleotide
  Target: ANGPTL3; (+) strand; PAM type: YTN; PAM sequence: CTT
agtagaaaagagtaataccc

SEQ ID NO: 15095 - DNA, 20 bp, Artificial Sequence
  Description of Artificial Sequence: Synthetic oligonucleotide
  Target: ANGPTL3; (+) strand; PAM type: YTN; PAM sequence: TTA
gtagaaaagagtaataccca

SEQ ID NO: 15096 - DNA, 20 bp, Artificial Sequence
  Description of Artificial Sequence: Synthetic oligonucleotide
  Target: ANGPTL3; (+) strand; PAM type: YTN; PAM sequence: CTT
tacaatagatccttttaaat

SEQ ID NO: 15097 - DNA, 20 bp, Artificial Sequence
  Description of Artificial Sequence: Synthetic oligonucleotide
  Target: ANGPTL3; (+) strand; PAM type: YTN; PAM sequence: TTT
acaatagatccttttaaata

SEQ ID NO: 15098 - DNA, 20 bp, Artificial Sequence
  Description of Artificial Sequence: Synthetic oligonucleotide
  Target: ANGPTL3; (+) strand; PAM type: YTN; PAM sequence: TTA
caatagatccttttaaataa

SEQ ID NO: 15099 - DNA, 20 bp, Artificial Sequence
  Description of Artificial Sequence: Synthetic oligonucleotide
  Target: ANGPTL3; (+) strand; PAM type: YTN; PAM sequence: CTT
ttaaataaggtcctaggaaa

SEQ ID NO: 15100 - DNA, 20 bp, Artificial Sequence
  Description of Artificial Sequence: Synthetic oligonucleotide
  Target: ANGPTL3; (+) strand; PAM type: YTN; PAM sequence: TTT
taaataaggtcctaggaaat

SEQ ID NO: 15101 - DNA, 20 bp, Artificial Sequence
  Description of Artificial Sequence: Synthetic oligonucleotide
  Target: ANGPTL3; (+) strand; PAM type: YTN; PAM sequence: TTT
aaataaggtcctaggaaata

SEQ ID NO: 15102 - DNA, 20 bp, Artificial Sequence
  Description of Artificial Sequence: Synthetic oligonucleotide
  Target: ANGPTL3; (+) strand; PAM type: YTN; PAM sequence: TTA
aataaggtcctaggaaatat

SEQ ID NO: 15103 - DNA, 20 bp, Artificial Sequence
  Description of Artificial Sequence: Synthetic oligonucleotide
  Target: ANGPTL3; (+) strand; PAM type: YTN; PAM sequence: CTA
ggaaatatcattcatgccag

SEQ ID NO: 15104 - DNA, 20 bp, Artificial Sequence
  Description of Artificial Sequence: Synthetic oligonucleotide
  Target: ANGPTL3; (+) strand; PAM type: YTN; PAM sequence: TTC
atgccagcatcaaaaaacta

SEQ ID NO: 15105 - DNA, 20 bp, Artificial Sequence
  Description of Artificial Sequence: Synthetic oligonucleotide
  Target: ANGPTL3; (+) strand; PAM type: YTN; PAM sequence: CTA
acactaataatgcaagatat

SEQ ID NO: 15106 - DNA, 20 bp, Artificial Sequence
  Description of Artificial Sequence: Synthetic oligonucleotide
  Target: ANGPTL3; (+) strand; PAM type: YTN; PAM sequence: CTA
ataatgcaagatattatata

SEQ ID NO: 15107 - DNA, 20 bp, Artificial Sequence
  Description of Artificial Sequence: Synthetic oligonucleotide
  Target: ANGPTL3; (+) strand; PAM type: YTN; PAM sequence: TTA
tatattctgcttttcttact

SEQ ID NO: 15108 - DNA, 20 bp, Artificial Sequence
  Description of Artificial Sequence: Synthetic oligonucleotide
  Target: ANGPTL3; (+) strand; PAM type: YTN; PAM sequence: TTC
tgcttttcttactgtcaatg

SEQ ID NO: 15109 - DNA, 20 bp, Artificial Sequence
  Description of Artificial Sequence: Synthetic oligonucleotide
  Target: ANGPTL3; (+) strand; PAM type: YTN; PAM sequence: CTG
cttttcttactgtcaatgag

SEQ ID NO: 15110 - DNA, 20 bp, Artificial Sequence
  Description of Artificial Sequence: Synthetic oligonucleotide
  Target: ANGPTL3; (+) strand; PAM type: YTN; PAM sequence: CTT
ttcttactgtcaatgagaaa

SEQ ID NO: 15111 - DNA, 20 bp, Artificial Sequence
  Description of Artificial Sequence: Synthetic oligonucleotide
  Target: ANGPTL3; (+) strand; PAM type: YTN; PAM sequence: TTT
tcttactgtcaatgagaaaa

SEQ ID NO: 15112 - DNA, 20 bp, Artificial Sequence
  Description of Artificial Sequence: Synthetic oligonucleotide
  Target: ANGPTL3; (+) strand; PAM type: YTN; PAM sequence: TTT
cttactgtcaatgagaaaaa

SEQ ID NO: 15113 - DNA, 20 bp, Artificial Sequence
  Description of Artificial Sequence: Synthetic oligonucleotide
  Target: ANGPTL3; (+) strand; PAM type: YTN; PAM sequence: TTC
ttactgtcaatgagaaaaac

SEQ ID NO: 15114 - DNA, 20 bp, Artificial Sequence
  Description of Artificial Sequence: Synthetic oligonucleotide
  Target: ANGPTL3; (+) strand; PAM type: YTN; PAM sequence: CTT
actgtcaatgagaaaaacta

SEQ ID NO: 15115 - DNA, 20 bp, Artificial Sequence
  Description of Artificial Sequence: Synthetic oligonucleotide
  Target: ANGPTL3; (+) strand; PAM type: YTN; PAM sequence: TTA
ctgtcaatgagaaaaactat

SEQ ID NO: 15116 - DNA, 20 bp, Artificial Sequence
  Description of Artificial Sequence: Synthetic oligonucleotide
  Target: ANGPTL3; (+) strand; PAM type: YTN; PAM sequence: CTG
tcaatgagaaaaactatcat

SEQ ID NO: 15117 - DNA, 20 bp, Artificial Sequence
  Description of Artificial Sequence: Synthetic oligonucleotide
  Target: ANGPTL3; (+) strand; PAM type: YTN; PAM sequence: CTA
tcattcaataaattgcaaac

SEQ ID NO: 15118 - DNA, 20 bp, Artificial Sequence
  Description of Artificial Sequence: Synthetic oligonucleotide
  Target: ANGPTL3; (+) strand; PAM type: YTN; PAM sequence: TTC
aataaattgcaaacccaaca

SEQ ID NO: 15119 - DNA, 20 bp, Artificial Sequence
  Description of Artificial Sequence: Synthetic oligonucleotide
  Target: ANGPTL3; (+) strand; PAM type: YTN; PAM sequence: TTG
caaacccaacacacttaaat

SEQ ID NO: 15120 - DNA, 20 bp, Artificial Sequence
  Description of Artificial Sequence: Synthetic oligonucleotide
  Target: ANGPTL3; (+) strand; PAM type: YTN; PAM sequence: CTT
aaataaaaataaaatgttac

SEQ ID NO: 15121 - DNA, 20 bp, Artificial Sequence
  Description of Artificial Sequence: Synthetic oligonucleotide
  Target: ANGPTL3; (+) strand; PAM type: YTN; PAM sequence: TTA
aataaaaataaaatgttact

SEQ ID NO: 15122 - DNA, 20 bp, Artificial Sequence
  Description of Artificial Sequence: Synthetic oligonucleotide
  Target: ANGPTL3; (+) strand; PAM type: YTN; PAM sequence: TTA
ctgctaaactaacgataaac

SEQ ID NO: 15123 - DNA, 20 bp, Artificial Sequence
  Description of Artificial Sequence: Synthetic oligonucleotide
  Target: ANGPTL3; (+) strand; PAM type: YTN; PAM sequence: CTG
ctaaactaacgataaactac

SEQ ID NO: 15124 - DNA, 20 bp, Artificial Sequence
  Description of Artificial Sequence: Synthetic oligonucleotide
  Target: ANGPTL3; (+) strand; PAM type: YTN; PAM sequence: CTA
aactaacgataaactactga

SEQ ID NO: 15125 - DNA, 20 bp, Artificial Sequence
  Description of Artificial Sequence: Synthetic oligonucleotide
  Target: ANGPTL3; (+) strand; PAM type: YTN; PAM sequence: CTA
acgataaactactgaatata

SEQ ID NO: 15126 - DNA, 20 bp, Artificial Sequence
  Description of Artificial Sequence: Synthetic oligonucleotide
  Target: ANGPTL3; (+) strand; PAM type: YTN; PAM sequence: CTA
ctgaatatatagaaagtaag

SEQ ID NO: 15127 - DNA, 20 bp, Artificial Sequence
  Description of Artificial Sequence: Synthetic oligonucleotide
  Target: ANGPTL3; (+) strand; PAM type: YTN; PAM sequence: CTG
aatatatagaaagtaagcaa

SEQ ID NO: 15128 - DNA, 20 bp, Artificial Sequence
  Description of Artificial Sequence: Synthetic oligonucleotide
  Target: ANGPTL3; (+) strand; PAM type: YTN; PAM sequence: CTT
gccaacctgccaacatctac

SEQ ID NO: 15129 - DNA, 20 bp, Artificial Sequence
  Description of Artificial Sequence: Synthetic oligonucleotide
  Target: ANGPTL3; (+) strand; PAM type: YTN; PAM sequence: TTG
ccaacctgccaacatctaca

SEQ ID NO: 15130 - DNA, 20 bp, Artificial Sequence
  Description of Artificial Sequence: Synthetic oligonucleotide
  Target: ANGPTL3; (+) strand; PAM type: YTN; PAM sequence: CTG
ccaacatctacagatatgtt

SEQ ID NO: 15131 - DNA, 20 bp, Artificial Sequence
  Description of Artificial Sequence: Synthetic oligonucleotide
  Target: ANGPTL3; (+) strand; PAM type: YTN; PAM sequence: CTA
cagatatgtttacaggtcaa

SEQ ID NO: 15132 - DNA, 20 bp, Artificial Sequence
  Description of Artificial Sequence: Synthetic oligonucleotide
  Target: ANGPTL3; (+) strand; PAM type: YTN; PAM sequence: TTT
acaggtcaaaaattatcaaa

SEQ ID NO: 15133 - DNA, 20 bp, Artificial Sequence
  Description of Artificial Sequence: Synthetic oligonucleotide
  Target: ANGPTL3; (+) strand; PAM type: YTN; PAM sequence: TTA
caggtcaaaaattatcaaat

SEQ ID NO: 15134 - DNA, 20 bp, Artificial Sequence
  Description of Artificial Sequence: Synthetic oligonucleotide
  Target: ANGPTL3; (+) strand; PAM type: YTN; PAM sequence: TTA
tcaaattatcaagaaagcct

SEQ ID NO: 15135 - DNA, 20 bp, Artificial Sequence
  Description of Artificial Sequence: Synthetic oligonucleotide
  Target: ANGPTL3; (+) strand; PAM type: YTN; PAM sequence: TTA
tcaagaaagcctggttcaaa

SEQ ID NO: 15136 - DNA, 20 bp, Artificial Sequence
  Description of Artificial Sequence: Synthetic oligonucleotide
  Target: ANGPTL3; (+) strand; PAM type: YTN; PAM sequence: CTG
gttcaaattatgtattatgt

SEQ ID NO: 15137 - DNA, 20 bp, Artificial Sequence
  Description of Artificial Sequence: Synthetic oligonucleotide
  Target: ANGPTL3; (+) strand; PAM type: YTN; PAM sequence: TTC
aaattatgtattatgtcttt

SEQ ID NO: 15138 - DNA, 20 bp, Artificial Sequence
  Description of Artificial Sequence: Synthetic oligonucleotide
  Target: ANGPTL3; (+) strand; PAM type: YTN; PAM sequence: TTA
tgtattatgtctttatcaca

SEQ ID NO: 15139 - DNA, 20 bp, Artificial Sequence
  Description of Artificial Sequence: Synthetic oligonucleotide
  Target: ANGPTL3; (+) strand; PAM type: YTN; PAM sequence: TTA
tgtctttatcacaggtctga

SEQ ID NO: 15140 - DNA, 20 bp, Artificial Sequence
  Description of Artificial Sequence: Synthetic oligonucleotide
  Target: ANGPTL3; (+) strand; PAM type: YTN; PAM sequence: CTT
tatcacaggtctgaagatca

SEQ ID NO: 15141 - DNA, 20 bp, Artificial Sequence
  Description of Artificial Sequence: Synthetic oligonucleotide
  Target: ANGPTL3; (+) strand; PAM type: YTN; PAM sequence: TTT
atcacaggtctgaagatcag

SEQ ID NO: 15142 - DNA, 20 bp, Artificial Sequence
  Description of Artificial Sequence: Synthetic oligonucleotide
  Target: ANGPTL3; (+) strand; PAM type: YTN; PAM sequence: TTA
tcacaggtctgaagatcagt

SEQ ID NO: 15143 - DNA, 20 bp, Artificial Sequence
  Description of Artificial Sequence: Synthetic oligonucleotide
  Target: ANGPTL3; (+) strand; PAM type: YTN; PAM sequence: CTG
aagatcagtaagacctaaaa

SEQ ID NO: 15144 - DNA, 20 bp, Artificial Sequence
  Description of Artificial Sequence: Synthetic oligonucleotide
  Target: ANGPTL3; (+) strand; PAM type: YTN; PAM sequence: CTA
aaactgaaaattattaaact

SEQ ID NO: 15145 - DNA, 20 bp, Artificial Sequence
  Description of Artificial Sequence: Synthetic oligonucleotide
  Target: ANGPTL3; (+) strand; PAM type: YTN; PAM sequence: CTG
aaaattattaaacttaaaat

SEQ ID NO: 15146 - DNA, 20 bp, Artificial Sequence
  Description of Artificial Sequence: Synthetic oligonucleotide
  Target: ANGPTL3; (+) strand; PAM type: YTN; PAM sequence: TTA
ttaaacttaaaatctgaaca

SEQ ID NO: 15147 - DNA, 20 bp, Artificial Sequence
  Description of Artificial Sequence: Synthetic oligonucleotide
  Target: ANGPTL3; (+) strand; PAM type: YTN; PAM sequence: TTA
aacttaaaatctgaacagaa

SEQ ID NO: 15148 - DNA, 20 bp, Artificial Sequence
  Description of Artificial Sequence: Synthetic oligonucleotide
  Target: ANGPTL3; (+) strand; PAM type: YTN; PAM sequence: CTT
aaaatctgaacagaatatca

SEQ ID NO: 15149 - DNA, 20 bp, Artificial Sequence
  Description of Artificial Sequence: Synthetic oligonucleotide
  Target: ANGPTL3; (+) strand; PAM type: YTN; PAM sequence: TTA
aaatctgaacagaatatcaa

SEQ ID NO: 15150 - DNA, 20 bp, Artificial Sequence
  Description of Artificial Sequence: Synthetic oligonucleotide
  Target: ANGPTL3; (+) strand; PAM type: YTN; PAM sequence: CTG
aacagaatatcaaatatatt

SEQ ID NO: 15151 - DNA, 20 bp, Artificial Sequence
  Description of Artificial Sequence: Synthetic oligonucleotide
  Target: ANGPTL3; (+) strand; PAM type: YTN; PAM sequence: TTT
tattcatataaataaaagaa

SEQ ID NO: 15152 - DNA, 20 bp, Artificial Sequence
  Description of Artificial Sequence: Synthetic oligonucleotide
  Target: ANGPTL3; (+) strand; PAM type: YTN; PAM sequence: TTT
attcatataaataaaagaat

SEQ ID NO: 15153 - DNA, 20 bp, Artificial Sequence
  Description of Artificial Sequence: Synthetic oligonucleotide
  Target: ANGPTL3; (+) strand; PAM type: YTN; PAM sequence: TTA
ttcatataaataaaagaata

SEQ ID NO: 15154 - DNA, 20 bp, Artificial Sequence
  Description of Artificial Sequence: Synthetic oligonucleotide
  Target: ANGPTL3; (+) strand; PAM type: YTN; PAM sequence: TTC
atataaataaaagaatacat

SEQ ID NO: 15155 - DNA, 20 bp, Artificial Sequence
  Description of Artificial Sequence: Synthetic oligonucleotide
  Target: ANGPTL3; (+) strand; PAM type: YTN; PAM sequence: TTA
caatattctaagcaaagcag

SEQ ID NO: 15156 - DNA, 20 bp, Artificial Sequence
  Description of Artificial Sequence: Synthetic oligonucleotide
  Target: ANGPTL3; (+) strand; PAM type: YTN; PAM sequence: TTC
taagcaaagcagtctctact

SEQ ID NO: 15157 - DNA, 20 bp, Artificial Sequence
  Description of Artificial Sequence: Synthetic oligonucleotide
  Target: ANGPTL3; (+) strand; PAM type: YTN; PAM sequence: CTA
agcaaagcagtctctacttt

SEQ ID NO: 15158 - DNA, 20 bp, Artificial Sequence
  Description of Artificial Sequence: Synthetic oligonucleotide
  Target: ANGPTL3; (+) strand; PAM type: YTN; PAM sequence: CTC
tacttttggccttgctctgt

SEQ ID NO: 15159 - DNA, 20 bp, Artificial Sequence
  Description of Artificial Sequence: Synthetic oligonucleotide
  Target: ANGPTL3; (+) strand; PAM type: YTN; PAM sequence: CTA
cttttggccttgctctgttt

SEQ ID NO: 15160 - DNA, 20 bp, Artificial Sequence
  Description of Artificial Sequence: Synthetic oligonucleotide
  Target: ANGPTL3; (+) strand; PAM type: YTN; PAM sequence: CTT
ttggccttgctctgttttcc

SEQ ID NO: 15161 - DNA, 20 bp, Artificial Sequence
  Description of Artificial Sequence: Synthetic oligonucleotide
  Target: ANGPTL3; (+) strand; PAM type: YTN; PAM sequence: TTT
tggccttgctctgttttccg

SEQ ID NO: 15162 - DNA, 20 bp, Artificial Sequence
  Description of Artificial Sequence: Synthetic oligonucleotide
  Target: ANGPTL3; (+) strand; PAM type: YTN; PAM sequence: TTT
ggccttgctctgttttccga

SEQ ID NO: 15163 - DNA, 20 bp, Artificial Sequence
  Description of Artificial Sequence: Synthetic oligonucleotide
  Target: ANGPTL3; (+) strand; PAM type: YTN; PAM sequence: TTG
gccttgctctgttttccgac

SEQ ID NO: 15164 - DNA, 20 bp, Artificial Sequence
  Description of Artificial Sequence: Synthetic oligonucleotide
  Target: ANGPTL3; (+) strand; PAM type: YTN; PAM sequence: CTT
gctctgttttccgaccaatg

SEQ ID NO: 15165 - DNA, 20 bp, Artificial Sequence
  Description of Artificial Sequence: Synthetic oligonucleotide
  Target: ANGPTL3; (+) strand; PAM type: YTN; PAM sequence: TTG
ctctgttttccgaccaatgt

SEQ ID NO: 15166 - DNA, 20 bp, Artificial Sequence
  Description of Artificial Sequence: Synthetic oligonucleotide
  Target: ANGPTL3; (+) strand; PAM type: YTN; PAM sequence: CTC
tgttttccgaccaatgtctg

SEQ ID NO: 15167 - DNA, 20 bp, Artificial Sequence
  Description of Artificial Sequence: Synthetic oligonucleotide
  Target: ANGPTL3; (+) strand; PAM type: YTN; PAM sequence: CTG
ttttccgaccaatgtctgct

SEQ ID NO: 15168 - DNA, 20 bp, Artificial Sequence
  Description of Artificial Sequence: Synthetic oligonucleotide
  Target: ANGPTL3; (+) strand; PAM type: YTN; PAM sequence: TTT
tccgaccaatgtctgctttt

SEQ ID NO: 15169 - DNA, 20 bp, Artificial Sequence
  Description of Artificial Sequence: Synthetic oligonucleotide
  Target: ANGPTL3; (+) strand; PAM type: YTN; PAM sequence: TTT
ccgaccaatgtctgcttttt

SEQ ID NO: 15170 - DNA, 20 bp, Artificial Sequence
  Description of Artificial Sequence: Synthetic oligonucleotide
  Target: ANGPTL3; (+) strand; PAM type: YTN; PAM sequence: TTC
cgaccaatgtctgctttttt

SEQ ID NO: 15171 - DNA, 20 bp, Artificial Sequence
  Description of Artificial Sequence: Synthetic oligonucleotide
  Target: ANGPTL3; (+) strand; PAM type: YTN; PAM sequence: CTG
cttttttgccttgctttatt

SEQ ID NO: 15172 - DNA, 20 bp, Artificial Sequence
  Description of Artificial Sequence: Synthetic oligonucleotide
  Target: ANGPTL3; (+) strand; PAM type: YTN; PAM sequence: CTT
ttttgccttgctttattttt

SEQ ID NO: 15173 - DNA, 20 bp, Artificial Sequence
  Description of Artificial Sequence: Synthetic oligonucleotide
  Target: ANGPTL3; (+) strand; PAM type: YTN; PAM sequence: TTT
tttgccttgctttatttttt

SEQ ID NO: 15174 - DNA, 20 bp, Artificial Sequence
  Description of Artificial Sequence: Synthetic oligonucleotide
  Target: ANGPTL3; (+) strand; PAM type: YTN; PAM sequence: TTT
ttgccttgctttattttttt

SEQ ID NO: 15175 - DNA, 20 bp, Artificial Sequence
  Description of Artificial Sequence: Synthetic oligonucleotide
  Target: ANGPTL3; (+) strand; PAM type: YTN; PAM sequence: TTT
tgccttgctttattttttta

SEQ ID NO: 15176 - DNA, 20 bp, Artificial Sequence
  Description of Artificial Sequence: Synthetic oligonucleotide
  Target: ANGPTL3; (+) strand; PAM type: YTN; PAM sequence: TTT
gccttgctttatttttttat

SEQ ID NO: 15177 - DNA, 20 bp, Artificial Sequence
  Description of Artificial Sequence: Synthetic oligonucleotide
  Target: ANGPTL3; (+) strand; PAM type: YTN; PAM sequence: TTG
ccttgctttatttttttatc

SEQ ID NO: 15178 - DNA, 20 bp, Artificial Sequence
  Description of Artificial Sequence: Synthetic oligonucleotide
  Target: ANGPTL3; (+) strand; PAM type: YTN; PAM sequence: CTT
gctttatttttttatcttat

SEQ ID NO: 15179 - DNA, 20 bp, Artificial Sequence
  Description of Artificial Sequence: Synthetic oligonucleotide
  Target: ANGPTL3; (+) strand; PAM type: YTN; PAM sequence: TTG
ctttatttttttatcttatt

SEQ ID NO: 15180 - DNA, 20 bp, Artificial Sequence
  Description of Artificial Sequence: Synthetic oligonucleotide
  Target: ANGPTL3; (+) strand; PAM type: YTN; PAM sequence: CTT
tatttttttatcttattaaa

SEQ ID NO: 15181 - DNA, 20 bp, Artificial Sequence
  Description of Artificial Sequence: Synthetic oligonucleotide
  Target: ANGPTL3; (+) strand; PAM type: YTN; PAM sequence: TTT
atttttttatcttattaaat

SEQ ID NO: 15182 - DNA, 20 bp, Artificial Sequence
  Description of Artificial Sequence: Synthetic oligonucleotide
  Target: ANGPTL3; (+) strand; PAM type: YTN; PAM sequence: TTA
tttttttatcttattaaata

SEQ ID NO: 15183 - DNA, 20 bp, Artificial Sequence
  Description of Artificial Sequence: Synthetic oligonucleotide
  Target: ANGPTL3; (+) strand; PAM type: YTN; PAM sequence: TTT
ttttatcttattaaataatg

SEQ ID NO: 15184 - DNA, 20 bp, Artificial Sequence
  Description of Artificial Sequence: Synthetic oligonucleotide
  Target: ANGPTL3; (+) strand; PAM type: YTN; PAM sequence: TTT
tttatcttattaaataatgt

SEQ ID NO: 15185 - DNA, 20 bp, Artificial Sequence
  Description of Artificial Sequence: Synthetic oligonucleotide
  Target: ANGPTL3; (+) strand; PAM type: YTN; PAM sequence: TTT
ttatcttattaaataatgtc

SEQ ID NO: 15186 - DNA, 20 bp, Artificial Sequence
  Description of Artificial Sequence: Synthetic oligonucleotide
  Target: ANGPTL3; (+) strand; PAM type: YTN; PAM sequence: TTT
tatcttattaaataatgtcc

SEQ ID NO: 15187 - DNA, 20 bp, Artificial Sequence
  Description of Artificial Sequence: Synthetic oligonucleotide
  Target: ANGPTL3; (+) strand; PAM type: YTN; PAM sequence: TTT
atcttattaaataatgtccc

SEQ ID NO: 15188 - DNA, 20 bp, Artificial Sequence
  Description of Artificial Sequence: Synthetic oligonucleotide
  Target: ANGPTL3; (+) strand; PAM type: YTN; PAM sequence: TTA
tcttattaaataatgtccct

SEQ ID NO: 15189 - DNA, 20 bp, Artificial Sequence
  Description of Artificial Sequence: Synthetic oligonucleotide
  Target: ANGPTL3; (+) strand; PAM type: YTN; PAM sequence: CTT
attaaataatgtccctgatt

SEQ ID NO: 15190 - DNA, 20 bp, Artificial Sequence
  Description of Artificial Sequence: Synthetic oligonucleotide
  Target: ANGPTL3; (+) strand; PAM type: YTN; PAM sequence: TTA
ttaaataatgtccctgatta

SEQ ID NO: 15191 - DNA, 20 bp, Artificial Sequence
  Description of Artificial Sequence: Synthetic oligonucleotide
  Target: ANGPTL3; (+) strand; PAM type: YTN; PAM sequence: TTA
aataatgtccctgattaaat

SEQ ID NO: 15192 - DNA, 20 bp, Artificial Sequence
  Description of Artificial Sequence: Synthetic oligonucleotide
  Target: ANGPTL3; (+) strand; PAM type: YTN; PAM sequence: CTG
attaaatattttgagaacag

SEQ ID NO: 15193 - DNA, 20 bp, Artificial Sequence
  Description of Artificial Sequence: Synthetic oligonucleotide
  Target: ANGPTL3; (+) strand; PAM type: YTN; PAM sequence: TTA
aatattttgagaacaggtaa

SEQ ID NO: 15194 - DNA, 20 bp, Artificial Sequence
  Description of Artificial Sequence: Synthetic oligonucleotide
  Target: ANGPTL3; (+) strand; PAM type: YTN; PAM sequence: TTT
tgagaacaggtaatctgtac

SEQ ID NO: 15195 - DNA, 20 bp, Artificial Sequence
  Description of Artificial Sequence: Synthetic oligonucleotide
  Target: ANGPTL3; (+) strand; PAM type: YTN; PAM sequence: TTT
gagaacaggtaatctgtaca

SEQ ID NO: 15196 - DNA, 20 bp, Artificial Sequence
  Description of Artificial Sequence: Synthetic oligonucleotide
  Target: ANGPTL3; (+) strand; PAM type: YTN; PAM sequence: TTG
agaacaggtaatctgtacaa

SEQ ID NO: 15197 - DNA, 20 bp, Artificial Sequence
  Description of Artificial Sequence: Synthetic oligonucleotide
  Target: ANGPTL3; (+) strand; PAM type: YTN; PAM sequence: CTG
tacaatctgaataacactgt

SEQ ID NO: 15198 - DNA, 20 bp, Artificial Sequence
  Description of Artificial Sequence: Synthetic oligonucleotide
  Target: ANGPTL3; (+) strand; PAM type: YTN; PAM sequence: CTG
aataacactgtttatctaaa

SEQ ID NO: 15199 - DNA, 20 bp, Artificial Sequence
  Description of Artificial Sequence: Synthetic oligonucleotide
  Target: ANGPTL3; (+) strand; PAM type: YTN; PAM sequence: CTG
tttatctaaatatcaaacac

SEQ ID NO: 15200 - DNA, 20 bp, Artificial Sequence
  Description of Artificial Sequence: Synthetic oligonucleotide
  Target: ANGPTL3; (+) strand; PAM type: YTN; PAM sequence: TTT
atctaaatatcaaacaccgt

SEQ ID NO: 15201 - DNA, 20 bp, Artificial Sequence
  Description of Artificial Sequence: Synthetic oligonucleotide
  Target: ANGPTL3; (+) strand; PAM type: YTN; PAM sequence: TTA
tctaaatatcaaacaccgtt

SEQ ID NO: 15202 - DNA, 20 bp, Artificial Sequence
  Description of Artificial Sequence: Synthetic oligonucleotide
  Target: ANGPTL3; (+) strand; PAM type: YTN; PAM sequence: CTA
aatatcaaacaccgttataa

SEQ ID NO: 15203 - DNA, 20 bp, Artificial Sequence
  Description of Artificial Sequence: Synthetic oligonucleotide
  Target: ANGPTL3; (+) strand; PAM type: YTN; PAM sequence: TTA
taacattatgaactgaaaga

SEQ ID NO: 15204 - DNA, 20 bp, Artificial Sequence
  Description of Artificial Sequence: Synthetic oligonucleotide
  Target: ANGPTL3; (+) strand; PAM type: YTN; PAM sequence: TTA
tgaactgaaagacaaactgt

SEQ ID NO: 15205 - DNA, 20 bp, Artificial Sequence
  Description of Artificial Sequence: Synthetic oligonucleotide
  Target: ANGPTL3; (+) strand; PAM type: YTN; PAM sequence: CTG
aaagacaaactgtacttctg

SEQ ID NO: 15206 - DNA, 20 bp, Artificial Sequence
  Description of Artificial Sequence: Synthetic oligonucleotide
  Target: ANGPTL3; (+) strand; PAM type: YTN; PAM sequence: CTG
tacttctgacatccttactc

SEQ ID NO: 15207 - DNA, 20 bp, Artificial Sequence
  Description of Artificial Sequence: Synthetic oligonucleotide
  Target: ANGPTL3; (+) strand; PAM type: YTN; PAM sequence: CTT
ctgacatccttactcagatt

SEQ ID NO: 15208 - DNA, 20 bp, Artificial Sequence
  Description of Artificial Sequence: Synthetic oligonucleotide
  Target: ANGPTL3; (+) strand; PAM type: YTN; PAM sequence: TTC
tgacatccttactcagattt

SEQ ID NO: 15209 - DNA, 20 bp, Artificial Sequence
  Description of Artificial Sequence: Synthetic oligonucleotide
  Target: ANGPTL3; (+) strand; PAM type: YTN; PAM sequence: CTG
acatccttactcagatttcc

SEQ ID NO: 15210 - DNA, 20 bp, Artificial Sequence
  Description of Artificial Sequence: Synthetic oligonucleotide
  Target: ANGPTL3; (+) strand; PAM type: YTN; PAM sequence: CTT
actcagatttcccctaattg

SEQ ID NO: 15211 - DNA, 20 bp, Artificial Sequence
  Description of Artificial Sequence: Synthetic oligonucleotide
  Target: ANGPTL3; (+) strand; PAM type: YTN; PAM sequence: TTA
ctcagatttcccctaattgt

SEQ ID NO: 15212 - DNA, 20 bp, Artificial Sequence
  Description of Artificial Sequence: Synthetic oligonucleotide
  Target: ANGPTL3; (+) strand; PAM type: YTN; PAM sequence: CTC
agatttcccctaattgtata

SEQ ID NO: 15213 - DNA, 20 bp, Artificial Sequence
  Description of Artificial Sequence: Synthetic oligonucleotide
  Target: ANGPTL3; (+) strand; PAM type: YTN; PAM sequence: TTT
cccctaattgtatattcagt

SEQ ID NO: 15214 - DNA, 20 bp, Artificial Sequence
  Description of Artificial Sequence: Synthetic oligonucleotide
  Target: ANGPTL3; (+) strand; PAM type: YTN; PAM sequence: TTC
ccctaattgtatattcagta

SEQ ID NO: 15215 - DNA, 20 bp, Artificial Sequence
  Description of Artificial Sequence: Synthetic oligonucleotide
  Target: ANGPTL3; (+) strand; PAM type: YTN; PAM sequence: CTA
attgtatattcagtatcatt

SEQ ID NO: 15216 - DNA, 20 bp, Artificial Sequence
  Description of Artificial Sequence: Synthetic oligonucleotide
  Target: ANGPTL3; (+) strand; PAM type: YTN; PAM sequence: TTG
tatattcagtatcattttaa

SEQ ID NO: 15217 - DNA, 20 bp, Artificial Sequence
  Description of Artificial Sequence: Synthetic oligonucleotide
  Target: ANGPTL3; (+) strand; PAM type: YTN; PAM sequence: TTC
agtatcattttaaaaaacag

SEQ ID NO: 15218 - DNA, 20 bp, Artificial Sequence
  Description of Artificial Sequence: Synthetic oligonucleotide
  Target: ANGPTL3; (+) strand; PAM type: YTN; PAM sequence: TTT
taaaaaacagatttatattc

SEQ ID NO: 15219 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaacagatttatattct

SEQ ID NO: 15220 - DNA, 20 bp, Artificial Sequence
  Description of Artificial Sequence: Synthetic oligonucleotide
  Target: ANGPTL3; (+) strand; PAM type: YTN; PAM sequence: TTA
aaaaacagatttatattctt

SEQ ID NO: 15221 - DNA, 20 bp, Artificial Sequence
  Description of Artificial Sequence: Synthetic oligonucleotide
  Target: ANGPTL3; (+) strand; PAM type: YTN; PAM sequence: TTT
atattcttttatcagctcag

SEQ ID NO: 15222 - DNA, 20 bp, Artificial Sequence
  Description of Artificial Sequence: Synthetic oligonucleotide
  Target: ANGPTL3; (+) strand; PAM type: YTN; PAM sequence: TTA
tattcttttatcagctcaga

SEQ ID NO: 15223 - DNA, 20 bp, Artificial Sequence
  Description of Artificial Sequence: Synthetic oligonucleotide
  Target: ANGPTL3; (+) strand; PAM type: YTN; PAM sequence: TTC
ttttatcagctcagaaggac

SEQ ID NO: 15224 - DNA, 20 bp, Artificial Sequence
  Description of Artificial Sequence: Synthetic oligonucleotide
  Target: ANGPTL3; (+) strand; PAM type: YTN; PAM sequence: CTT
ttatcagctcagaaggacta

SEQ ID NO: 15225 - DNA, 20 bp, Artificial Sequence
  Description of Artificial Sequence: Synthetic oligonucleotide
  Target: ANGPTL3; (+) strand; PAM type: YTN; PAM sequence: TTT
tatcagctcagaaggactag

SEQ ID NO: 15226 - DNA, 20 bp, Artificial Sequence
  Description of Artificial Sequence: Synthetic oligonucleotide
  Target: ANGPTL3; (+) strand; PAM type: YTN; PAM sequence: TTT
atcagctcagaaggactagt

SEQ ID NO: 15227 - DNA, 20 bp, Artificial Sequence
  Description of Artificial Sequence: Synthetic oligonucleotide
  Target: ANGPTL3; (+) strand; PAM type: YTN; PAM sequence: TTA
tcagctcagaaggactagta

SEQ ID NO: 15228 - DNA, 20 bp, Artificial Sequence
  Description of Artificial Sequence: Synthetic oligonucleotide
  Target: ANGPTL3; (+) strand; PAM type: YTN; PAM sequence: CTC
agaaggactagtattcaaga

SEQ ID NO: 15229 - DNA, 20 bp, Artificial Sequence
  Description of Artificial Sequence: Synthetic oligonucleotide
  Target: ANGPTL3; (+) strand; PAM type: YTN; PAM sequence: CTA
gtattcaagaacccacagaa

SEQ ID NO: 15230 - DNA, 20 bp, Artificial Sequence
  Description of Artificial Sequence: Synthetic oligonucleotide
  Target: ANGPTL3; (+) strand; PAM type: YTN; PAM sequence: TTC
aagaacccacagaaatttct

SEQ ID NO: 15231 - DNA, 20 bp, Artificial Sequence
  Description of Artificial Sequence: Synthetic oligonucleotide
  Target: ANGPTL3; (+) strand; PAM type: YTN; PAM sequence: TTT
ctctatcttccaagccaaga

SEQ ID NO: 15232 - DNA, 20 bp, Artificial Sequence
  Description of Artificial Sequence: Synthetic oligonucleotide
  Target: ANGPTL3; (+) strand; PAM type: YTN; PAM sequence: TTC
tctatcttccaagccaagag

SEQ ID NO: 15233 - DNA, 20 bp, Artificial Sequence
  Description of Artificial Sequence: Synthetic oligonucleotide
  Target: ANGPTL3; (+) strand; PAM type: YTN; PAM sequence: CTC
tatcttccaagccaagagca

SEQ ID NO: 15234 - DNA, 20 bp, Artificial Sequence
  Description of Artificial Sequence: Synthetic oligonucleotide
  Target: ANGPTL3; (+) strand; PAM type: YTN; PAM sequence: CTA
tcttccaagccaagagcacc

SEQ ID NO: 15235 - DNA, 20 bp, Artificial Sequence
  Description of Artificial Sequence: Synthetic oligonucleotide
  Target: ANGPTL3; (+) strand; PAM type: YTN; PAM sequence: CTT
ccaagccaagagcaccaaga

SEQ ID NO: 15236 - DNA, 20 bp, Artificial Sequence
  Description of Artificial Sequence: Synthetic oligonucleotide
  Target: ANGPTL3; (+) strand; PAM type: YTN; PAM sequence: TTC
caagccaagagcaccaagaa

SEQ ID NO: 15237 - DNA, 20 bp, Artificial Sequence
  Description of Artificial Sequence: Synthetic oligonucleotide
  Target: ANGPTL3; (+) strand; PAM type: YTN; PAM sequence: CTA
ctccctttcttcagttgaat

SEQ ID NO: 15238 - DNA, 20 bp, Artificial Sequence
  Description of Artificial Sequence: Synthetic oligonucleotide
  Target: ANGPTL3; (+) strand; PAM type: YTN; PAM sequence: CTC
cctttcttcagttgaatgaa

SEQ ID NO: 15239 - DNA, 20 bp, Artificial Sequence
  Description of Artificial Sequence: Synthetic oligonucleotide
  Target: ANGPTL3; (+) strand; PAM type: YTN; PAM sequence: CTT
tcttcagttgaatgaaataa

SEQ ID NO: 15240 - DNA, 20 bp, Artificial Sequence
  Description of Artificial Sequence: Synthetic oligonucleotide
  Target: ANGPTL3; (+) strand; PAM type: YTN; PAM sequence: TTT
cttcagttgaatgaaataag

SEQ ID NO: 15241 - DNA, 20 bp, Artificial Sequence
  Description of Artificial Sequence: Synthetic oligonucleotide
  Target: ANGPTL3; (+) strand; PAM type: YTN; PAM sequence: TTC
ttcagttgaatgaaataaga

SEQ ID NO: 15242 - DNA, 20 bp, Artificial Sequence
  Description of Artificial Sequence: Synthetic oligonucleotide
  Target: ANGPTL3; (+) strand; PAM type: YTN; PAM sequence: CTT
cagttgaatgaaataagaaa

SEQ ID NO: 15243 - DNA, 20 bp, Artificial Sequence
  Description of Artificial Sequence: Synthetic oligonucleotide
  Target: ANGPTL3; (+) strand; PAM type: YTN; PAM sequence: TTC
agttgaatgaaataagaaat

SEQ ID NO: 15244 - DNA, 20 bp, Artificial Sequence
  Description of Artificial Sequence: Synthetic oligonucleotide
  Target: ANGPTL3; (+) strand; PAM type: YTN; PAM sequence: TTG
aatgaaataagaaatgtaaa

SEQ ID NO: 15245 - DNA, 20 bp, Artificial Sequence
  Description of Artificial Sequence: Synthetic oligonucleotide
  Target: ANGPTL3; (+) strand; PAM type: YTN; PAM sequence: CTT
tggtgggtttccttcttgaa

SEQ ID NO: 15246 - DNA, 20 bp, Artificial Sequence
  Description of Artificial Sequence: Synthetic oligonucleotide
  Target: ANGPTL3; (+) strand; PAM type: YTN; PAM sequence: TTT
ggtgggtttccttcttgaag

SEQ ID NO: 15247 - DNA, 20 bp, Artificial Sequence
  Description of Artificial Sequence: Synthetic oligonucleotide
  Target: ANGPTL3; (+) strand; PAM type: YTN; PAM sequence: TTG
gtgggtttccttcttgaagc

SEQ ID NO: 15248 - DNA, 20 bp, Artificial Sequence
  Description of Artificial Sequence: Synthetic oligonucleotide
  Target: ANGPTL3; (+) strand; PAM type: YTN; PAM sequence: TTT
ccttcttgaagctattatta

SEQ ID NO: 15249 - DNA, 20 bp, Artificial Sequence
  Description of Artificial Sequence: Synthetic oligonucleotide
  Target: ANGPTL3; (+) strand; PAM type: YTN; PAM sequence: TTC
cttcttgaagctattattat

SEQ ID NO: 15250 - DNA, 20 bp, Artificial Sequence
  Description of Artificial Sequence: Synthetic oligonucleotide
  Target: ANGPTL3; (+) strand; PAM type: YTN; PAM sequence: CTT
cttgaagctattattatcaa

SEQ ID NO: 15251 - DNA, 20 bp, Artificial Sequence
  Description of Artificial Sequence: Synthetic oligonucleotide
  Target: ANGPTL3; (+) strand; PAM type: YTN; PAM sequence: TTC
ttgaagctattattatcaaa

SEQ ID NO: 15252 - DNA, 20 bp, Artificial Sequence
  Description of Artificial Sequence: Synthetic oligonucleotide
  Target: ANGPTL3; (+) strand; PAM type: YTN; PAM sequence: CTT
gaagctattattatcaaatt

SEQ ID NO: 15253 - DNA, 20 bp, Artificial Sequence
  Description of Artificial Sequence: Synthetic oligonucleotide
  Target: ANGPTL3; (+) strand; PAM type: YTN; PAM sequence: TTG
aagctattattatcaaattc

SEQ ID NO: 15254 - DNA, 20 bp, Artificial Sequence
  Description of Artificial Sequence: Synthetic oligonucleotide
  Target: ANGPTL3; (+) strand; PAM type: YTN; PAM sequence: CTA
ttattatcaaattccctatt

SEQ ID NO: 15255 - DNA, 20 bp, Artificial Sequence
  Description of Artificial Sequence: Synthetic oligonucleotide
  Target: ANGPTL3; (+) strand; PAM type: YTN; PAM sequence: TTA
ttatcaaattccctattctt

SEQ ID NO: 15256 - DNA, 20 bp, Artificial Sequence
  Description of Artificial Sequence: Synthetic oligonucleotide
  Target: ANGPTL3; (+) strand; PAM type: YTN; PAM sequence: TTA
tcaaattccctattcttagg

SEQ ID NO: 15257 - DNA, 20 bp, Artificial Sequence
  Description of Artificial Sequence: Synthetic oligonucleotide
  Target: ANGPTL3; (+) strand; PAM type: YTN; PAM sequence: TTC
cctattcttaggacttgttc

SEQ ID NO: 15258 - DNA, 20 bp, Artificial Sequence
  Description of Artificial Sequence: Synthetic oligonucleotide
  Target: ANGPTL3; (+) strand; PAM type: YTN; PAM sequence: CTA
ttcttaggacttgttctaga

SEQ ID NO: 15259 - DNA, 20 bp, Artificial Sequence
  Description of Artificial Sequence: Synthetic oligonucleotide
  Target: ANGPTL3; (+) strand; PAM type: YTN; PAM sequence: TTC
ttaggacttgttctagacta

SEQ ID NO: 15260 - DNA, 20 bp, Artificial Sequence
  Description of Artificial Sequence: Synthetic oligonucleotide
  Target: ANGPTL3; (+) strand; PAM type: YTN; PAM sequence: CTT
aggacttgttctagactaaa

SEQ ID NO: 15261 - DNA, 20 bp, Artificial Sequence
  Description of Artificial Sequence: Synthetic oligonucleotide
  Target: ANGPTL3; (+) strand; PAM type: YTN; PAM sequence: TTA
ggacttgttctagactaaaa

SEQ ID NO: 15262 - DNA, 20 bp, Artificial Sequence
  Description of Artificial Sequence: Synthetic oligonucleotide
  Target: ANGPTL3; (+) strand; PAM type: YTN; PAM sequence: CTT
gttctagactaaaagatagt

SEQ ID NO: 15263 - DNA, 20 bp, Artificial Sequence
  Description of Artificial Sequence: Synthetic oligonucleotide
  Target: ANGPTL3; (+) strand; PAM type: YTN; PAM sequence: TTG
ttctagactaaaagatagtt

SEQ ID NO: 15264 - DNA, 20 bp, Artificial Sequence
  Description of Artificial Sequence: Synthetic oligonucleotide
  Target: ANGPTL3; (+) strand; PAM type: YTN; PAM sequence: TTC
tagactaaaagatagttaag

SEQ ID NO: 15265 - DNA, 20 bp, Artificial Sequence
  Description of Artificial Sequence: Synthetic oligonucleotide
  Target: ANGPTL3; (+) strand; PAM type: YTN; PAM sequence: CTA
gactaaaagatagttaagag

SEQ ID NO: 15266 - DNA, 20 bp, Artificial Sequence
  Description of Artificial Sequence: Synthetic oligonucleotide
  Target: ANGPTL3; (+) strand; PAM type: YTN; PAM sequence: CTA
aaagatagttaagagatatc

SEQ ID NO: 15267 - DNA, 20 bp, Artificial Sequence
  Description of Artificial Sequence: Synthetic oligonucleotide
  Target: ANGPTL3; (+) strand; PAM type: YTN; PAM sequence: TTA
agagatatccatcaaataca

SEQ ID NO: 15268 - DNA, 20 bp, Artificial Sequence
  Description of Artificial Sequence: Synthetic oligonucleotide
  Target: ANGPTL3; (+) strand; PAM type: YTN; PAM sequence: CTA
aactggatgctggggttctt

SEQ ID NO: 15269 - DNA, 20 bp, Artificial Sequence
  Description of Artificial Sequence: Synthetic oligonucleotide
  Target: ANGPTL3; (+) strand; PAM type: YTN; PAM sequence: CTG
gatgctggggttctttttac

SEQ ID NO: 15270 - DNA, 20 bp, Artificial Sequence
  Description of Artificial Sequence: Synthetic oligonucleotide
  Target: ANGPTL3; (+) strand; PAM type: YTN; PAM sequence: CTG
gggttctttttacaccctat

SEQ ID NO: 15271 - DNA, 20 bp, Artificial Sequence
  Description of Artificial Sequence: Synthetic oligonucleotide
  Target: ANGPTL3; (+) strand; PAM type: YTN; PAM sequence: TTC
tttttacaccctataaaaga

SEQ ID NO: 15272 - DNA, 20 bp, Artificial Sequence
  Description of Artificial Sequence: Synthetic oligonucleotide
  Target: ANGPTL3; (+) strand; PAM type: YTN; PAM sequence: CTT
tttacaccctataaaagaca

SEQ ID NO: 15273 - DNA, 20 bp, Artificial Sequence
  Description of Artificial Sequence: Synthetic oligonucleotide
  Target: ANGPTL3; (+) strand; PAM type: YTN; PAM sequence: TTT
ttacaccctataaaagacat

SEQ ID NO: 15274 - DNA, 20 bp, Artificial Sequence
  Description of Artificial Sequence: Synthetic oligonucleotide
  Target: ANGPTL3; (+) strand; PAM type: YTN; PAM sequence: TTT
tacaccctataaaagacata

SEQ ID NO: 15275 - DNA, 20 bp, Artificial Sequence
  Description of Artificial Sequence: Synthetic oligonucleotide
  Target: ANGPTL3; (+) strand; PAM type: YTN; PAM sequence: TTT
acaccctataaaagacatac

SEQ ID NO: 15276 - DNA, 20 bp, Artificial Sequence
  Description of Artificial Sequence: Synthetic oligonucleotide
  Target: ANGPTL3; (+) strand; PAM type: YTN; PAM sequence: TTA
caccctataaaagacatacc

SEQ ID NO: 15277 - DNA, 20 bp, Artificial Sequence
  Description of Artificial Sequence: Synthetic oligonucleotide
  Target: ANGPTL3; (+) strand; PAM type: YTN; PAM sequence: CTA
taaaagacatacctaagaca

SEQ ID NO: 15278 - DNA, 20 bp, Artificial Sequence
  Description of Artificial Sequence: Synthetic oligonucleotide
  Target: ANGPTL3; (+) strand; PAM type: YTN; PAM sequence: CTA
agacaatcagagaaatacaa

SEQ ID NO: 15279 - DNA, 20 bp, Artificial Sequence
  Description of Artificial Sequence: Synthetic oligonucleotide
  Target: ANGPTL3; (+) strand; PAM type: YTN; PAM sequence: CTT
gattattagataatatagaa

SEQ ID NO: 15280 - DNA, 20 bp, Artificial Sequence
  Description of Artificial Sequence: Synthetic oligonucleotide
  Target: ANGPTL3; (+) strand; PAM type: YTN; PAM sequence: TTG
attattagataatatagaag

SEQ ID NO: 15281 - DNA, 20 bp, Artificial Sequence
  Description of Artificial Sequence: Synthetic oligonucleotide
  Target: ANGPTL3; (+) strand; PAM type: YTN; PAM sequence: TTA
ttagataatatagaaggttt

SEQ ID NO: 15282 - DNA, 20 bp, Artificial Sequence
  Description of Artificial Sequence: Synthetic oligonucleotide
  Target: ANGPTL3; (+) strand; PAM type: YTN; PAM sequence: TTA
gataatatagaaggtttatt

SEQ ID NO: 15283 - DNA, 20 bp, Artificial Sequence
  Description of Artificial Sequence: Synthetic oligonucleotide
  Target: ANGPTL3; (+) strand; PAM type: YTN; PAM sequence: TTT
attaattttcttagatgtga

SEQ ID NO: 15284 - DNA, 20 bp, Artificial Sequence
  Description of Artificial Sequence: Synthetic oligonucleotide
  Target: ANGPTL3; (+) strand; PAM type: YTN; PAM sequence: TTA
ttaattttcttagatgtgat

SEQ ID NO: 15285 - DNA, 20 bp, Artificial Sequence
  Description of Artificial Sequence: Synthetic oligonucleotide
  Target: ANGPTL3; (+) strand; PAM type: YTN; PAM sequence: TTA
attttcttagatgtgatcat

SEQ ID NO: 15286 - DNA, 20 bp, Artificial Sequence
  Description of Artificial Sequence: Synthetic oligonucleotide
  Target: ANGPTL3; (+) strand; PAM type: YTN; PAM sequence: TTT
tcttagatgtgatcatggta

SEQ ID NO: 15287 - DNA, 20 bp, Artificial Sequence
  Description of Artificial Sequence: Synthetic oligonucleotide
  Target: ANGPTL3; (+) strand; PAM type: YTN; PAM sequence: TTT
cttagatgtgatcatggtat

SEQ ID NO: 15288 - DNA, 20 bp, Artificial Sequence
  Description of Artificial Sequence: Synthetic oligonucleotide
  Target: ANGPTL3; (+) strand; PAM type: YTN; PAM sequence: TTC
ttagatgtgatcatggtatt

SEQ ID NO: 15289 - DNA, 20 bp, Artificial Sequence
  Description of Artificial Sequence: Synthetic oligonucleotide
  Target: ANGPTL3; (+) strand; PAM type: YTN; PAM sequence: CTT
agatgtgatcatggtattgc

SEQ ID NO: 15290 - DNA, 20 bp, Artificial Sequence
  Description of Artificial Sequence: Synthetic oligonucleotide
  Target: ANGPTL3; (+) strand; PAM type: YTN; PAM sequence: TTA
gatgtgatcatggtattgca

SEQ ID NO: 15291 - DNA, 20 bp, Artificial Sequence
  Description of Artificial Sequence: Synthetic oligonucleotide
  Target: ANGPTL3; (+) strand; PAM type: YTN; PAM sequence: TTG
cagttttaaaggagaacaat

SEQ ID NO: 15292 - DNA, 20 bp, Artificial Sequence
  Description of Artificial Sequence: Synthetic oligonucleotide
  Target: ANGPTL3; (+) strand; PAM type: YTN; PAM sequence: TTT
taaaggagaacaatctcctg

SEQ ID NO: 15293 - DNA, 20 bp, Artificial Sequence
  Description of Artificial Sequence: Synthetic oligonucleotide
  Target: ANGPTL3; (+) strand; PAM type: YTN; PAM sequence: TTT
aaaggagaacaatctcctgt

SEQ ID NO: 15294 - DNA, 20 bp, Artificial Sequence
  Description of Artificial Sequence: Synthetic oligonucleotide
  Target: ANGPTL3; (+) strand; PAM type: YTN; PAM sequence: TTA
aaggagaacaatctcctgtt

SEQ ID NO: 15295 - DNA, 20 bp, Artificial Sequence
  Description of Artificial Sequence: Synthetic oligonucleotide
  Target: ANGPTL3; (+) strand; PAM type: YTN; PAM sequence: CTC
ctgtttaagagatacatgct

SEQ ID NO: 15296 - DNA, 20 bp, Artificial Sequence
  Description of Artificial Sequence: Synthetic oligonucleotide
  Target: ANGPTL3; (+) strand; PAM type: YTN; PAM sequence: CTG
tttaagagatacatgctgaa

SEQ ID NO: 15297 - DNA, 20 bp, Artificial Sequence
  Description of Artificial Sequence: Synthetic oligonucleotide
  Target: ANGPTL3; (+) strand; PAM type: YTN; PAM sequence: TTT
aagagatacatgctgaaata

SEQ ID NO: 15298 - DNA, 20 bp, Artificial Sequence
  Description of Artificial Sequence: Synthetic oligonucleotide
  Target: ANGPTL3; (+) strand; PAM type: YTN; PAM sequence: TTA
agagatacatgctgaaatat

SEQ ID NO: 15299 - DNA, 20 bp, Artificial Sequence
  Description of Artificial Sequence: Synthetic oligonucleotide
  Target: ANGPTL3; (+) strand; PAM type: YTN; PAM sequence: CTG
aaatatttacggagttaaag

SEQ ID NO: 15300 - DNA, 20 bp, Artificial Sequence
  Description of Artificial Sequence: Synthetic oligonucleotide
  Target: ANGPTL3; (+) strand; PAM type: YTN; PAM sequence: TTT
acggagttaaaggtcactgg

SEQ ID NO: 15301 - DNA, 20 bp, Artificial Sequence
  Description of Artificial Sequence: Synthetic oligonucleotide
  Target: ANGPTL3; (+) strand; PAM type: YTN; PAM sequence: TTA
cggagttaaaggtcactgga

SEQ ID NO: 15302 - DNA, 20 bp, Artificial Sequence
  Description of Artificial Sequence: Synthetic oligonucleotide
  Target: ANGPTL3; (+) strand; PAM type: YTN; PAM sequence: TTA
aaggtcactggactccagac

SEQ ID NO: 15303 - DNA, 20 bp, Artificial Sequence
  Description of Artificial Sequence: Synthetic oligonucleotide
  Target: ANGPTL3; (+) strand; PAM type: YTN; PAM sequence: CTG
gactccagactggtgataga

SEQ ID NO: 15304 - DNA, 20 bp, Artificial Sequence
  Description of Artificial Sequence: Synthetic oligonucleotide
  Target: ANGPTL3; (+) strand; PAM type: YTN; PAM sequence: CTC
cagactggtgatagaacaag

SEQ ID NO: 15305 - DNA, 20 bp, Artificial Sequence
  Description of Artificial Sequence: Synthetic oligonucleotide
  Target: ANGPTL3; (+) strand; PAM type: YTN; PAM sequence: CTG
gtgatagaacaagactctgt

SEQ ID NO: 15306 - DNA, 20 bp, Artificial Sequence
  Description of Artificial Sequence: Synthetic oligonucleotide
  Target: ANGPTL3; (+) strand; PAM type: YTN; PAM sequence: CTC
tgtctctaaaaaataattaa

SEQ ID NO: 15307 - DNA, 20 bp, Artificial Sequence
  Description of Artificial Sequence: Synthetic oligonucleotide
  Target: ANGPTL3; (+) strand; PAM type: YTN; PAM sequence: CTG
tctctaaaaaataattaatt

SEQ ID NO: 15308 - DNA, 20 bp, Artificial Sequence
  Description of Artificial Sequence: Synthetic oligonucleotide
  Target: ANGPTL3; (+) strand; PAM type: YTN; PAM sequence: CTC
taaaaaataattaatttttt

SEQ ID NO: 15309 - DNA, 20 bp, Artificial Sequence
  Description of Artificial Sequence: Synthetic oligonucleotide
  Target: ANGPTL3; (+) strand; PAM type: YTN; PAM sequence: CTA
aaaaataattaattttttaa

SEQ ID NO: 15310 - DNA, 20 bp, Artificial Sequence
  Description of Artificial Sequence: Synthetic oligonucleotide
  Target: ANGPTL3; (+) strand; PAM type: YTN; PAM sequence: TTA
attttttaaaagaaaatagt

SEQ ID NO: 15311 - DNA, 20 bp, Artificial Sequence
  Description of Artificial Sequence: Synthetic oligonucleotide
  Target: ANGPTL3; (+) strand; PAM type: YTN; PAM sequence: TTT
tttaaaagaaaatagtttgg

SEQ ID NO: 15312 - DNA, 20 bp, Artificial Sequence
  Description of Artificial Sequence: Synthetic oligonucleotide
  Target: ANGPTL3; (+) strand; PAM type: YTN; PAM sequence: TTT
ttaaaagaaaatagtttggt

SEQ ID NO: 15313 - DNA, 20 bp, Artificial Sequence
  Description of Artificial Sequence: Synthetic oligonucleotide
  Target: ANGPTL3; (+) strand; PAM type: YTN; PAM sequence: TTT
taaaagaaaatagtttggta

SEQ ID NO: 15314 - DNA, 20 bp, Artificial Sequence
  Description of Artificial Sequence: Synthetic oligonucleotide
  Target: ANGPTL3; (+) strand; PAM type: YTN; PAM sequence: TTT
aaaagaaaatagtttggtaa

SEQ ID NO: 15315 - DNA, 20 bp, Artificial Sequence
  Description of Artificial Sequence: Synthetic oligonucleotide
  Target: ANGPTL3; (+) strand; PAM type: YTN; PAM sequence: TTA
aaagaaaatagtttggtaag

SEQ ID NO: 15316 - DNA, 20 bp, Artificial Sequence
  Description of Artificial Sequence: Synthetic oligonucleotide
  Target: ANGPTL3; (+) strand; PAM type: YTN; PAM sequence: TTT
ggtaagatgattcttacatt

SEQ ID NO: 15317 - DNA, 20 bp, Artificial Sequence
  Description of Artificial Sequence: Synthetic oligonucleotide
  Target: ANGPTL3; (+) strand; PAM type: YTN; PAM sequence: TTG
gtaagatgattcttacattc

SEQ ID NO: 15318 - DNA, 20 bp, Artificial Sequence
  Description of Artificial Sequence: Synthetic oligonucleotide
  Target: ANGPTL3; (+) strand; PAM type: YTN; PAM sequence: TTC
ttacattcttaaataacacg

SEQ ID NO: 15319 - DNA, 20 bp, Artificial Sequence
  Description of Artificial Sequence: Synthetic oligonucleotide
  Target: ANGPTL3; (+) strand; PAM type: YTN; PAM sequence: CTT
acattcttaaataacacgcc

SEQ ID NO: 15320 - DNA, 20 bp, Artificial Sequence
  Description of Artificial Sequence: Synthetic oligonucleotide
  Target: ANGPTL3; (+) strand; PAM type: YTN; PAM sequence: TTA
cattcttaaataacacgcca

SEQ ID NO: 15321 - DNA, 20 bp, Artificial Sequence
  Description of Artificial Sequence: Synthetic oligonucleotide
  Target: ANGPTL3; (+) strand; PAM type: YTN; PAM sequence: TTC
ttaaataacacgccatctaa

SEQ ID NO: 15322 - DNA, 20 bp, Artificial Sequence
  Description of Artificial Sequence: Synthetic oligonucleotide
  Target: ANGPTL3; (+) strand; PAM type: YTN; PAM sequence: CTT
aaataacacgccatctaaga

SEQ ID NO: 15323 - DNA, 20 bp, Artificial Sequence
  Description of Artificial Sequence: Synthetic oligonucleotide
  Target: ANGPTL3; (+) strand; PAM type: YTN; PAM sequence: TTA
aataacacgccatctaagaa

SEQ ID NO: 15324 - DNA, 20 bp, Artificial Sequence
  Description of Artificial Sequence: Synthetic oligonucleotide
  Target: ANGPTL3; (+) strand; PAM type: YTN; PAM sequence: CTA
agaaaaatgctttaacataa

SEQ ID NO: 15325 - DNA, 20 bp, Artificial Sequence
  Description of Artificial Sequence: Synthetic oligonucleotide
  Target: ANGPTL3; (+) strand; PAM type: YTN; PAM sequence: CTT
taacataaacattactgaaa

SEQ ID NO: 15326 - DNA, 20 bp, Artificial Sequence
  Description of Artificial Sequence: Synthetic oligonucleotide
  Target: ANGPTL3; (+) strand; PAM type: YTN; PAM sequence: TTT
aacataaacattactgaaaa

SEQ ID NO: 15327 - DNA, 20 bp, Artificial Sequence
  Description of Artificial Sequence: Synthetic oligonucleotide
  Target: ANGPTL3; (+) strand; PAM type: YTN; PAM sequence: TTA
acataaacattactgaaaaa

SEQ ID NO: 15328 - DNA, 20 bp, Artificial Sequence
  Description of Artificial Sequence: Synthetic oligonucleotide
  Target: ANGPTL3; (+) strand; PAM type: YTN; PAM sequence: TTA
ctgaaaaaatgctacatttg

SEQ ID NO: 15329 - DNA, 20 bp, Artificial Sequence
  Description of Artificial Sequence: Synthetic oligonucleotide
  Target: ANGPTL3; (+) strand; PAM type: YTN; PAM sequence: CTG
aaaaaatgctacatttgcca

SEQ ID NO: 15330 - DNA, 20 bp, Artificial Sequence
  Description of Artificial Sequence: Synthetic oligonucleotide
  Target: ANGPTL3; (+) strand; PAM type: YTN; PAM sequence: CTA
catttgccacaacttcataa

SEQ ID NO: 15331 - DNA, 20 bp, Artificial Sequence
  Description of Artificial Sequence: Synthetic oligonucleotide
  Target: ANGPTL3; (+) strand; PAM type: YTN; PAM sequence: TTT
gccacaacttcataaaatgt

SEQ ID NO: 15332 - DNA, 20 bp, Artificial Sequence
  Description of Artificial Sequence: Synthetic oligonucleotide
  Target: ANGPTL3; (+) strand; PAM type: YTN; PAM sequence: TTG
ccacaacttcataaaatgtc

SEQ ID NO: 15333 - DNA, 20 bp, Artificial Sequence
  Description of Artificial Sequence: Synthetic oligonucleotide
  Target: ANGPTL3; (+) strand; PAM type: YTN; PAM sequence: CTT
cataaaatgtcaagtgaaat

SEQ ID NO: 15334 - DNA, 20 bp, Artificial Sequence
  Description of Artificial Sequence: Synthetic oligonucleotide
  Target: ANGPTL3; (+) strand; PAM type: YTN; PAM sequence: TTC
ataaaatgtcaagtgaaatc

SEQ ID NO: 15335 - DNA, 20 bp, Artificial Sequence
  Description of Artificial Sequence: Synthetic oligonucleotide
  Target: ANGPTL3; (+) strand; PAM type: YTN; PAM sequence: CTC
aagctccaaagatattattc

SEQ ID NO: 15336 - DNA, 20 bp, Artificial Sequence
  Description of Artificial Sequence: Synthetic oligonucleotide
  Target: ANGPTL3; (+) strand; PAM type: YTN; PAM sequence: CTC
caaagatattattcctatta

SEQ ID NO: 15337 - DNA, 20 bp, Artificial Sequence
  Description of Artificial Sequence: Synthetic oligonucleotide
  Target: ANGPTL3; (+) strand; PAM type: YTN; PAM sequence: TTA
ttcctattactaaatctgat

SEQ ID NO: 15338 - DNA, 20 bp, Artificial Sequence
  Description of Artificial Sequence: Synthetic oligonucleotide
  Target: ANGPTL3; (+) strand; PAM type: YTN; PAM sequence: TTC
ctattactaaatctgatgta

SEQ ID NO: 15339 - DNA, 20 bp, Artificial Sequence
  Description of Artificial Sequence: Synthetic oligonucleotide
  Target: ANGPTL3; (+) strand; PAM type: YTN; PAM sequence: CTA
ttactaaatctgatgtaata

SEQ ID NO: 15340 - DNA, 20 bp, Artificial Sequence
  Description of Artificial Sequence: Synthetic oligonucleotide
  Target: ANGPTL3; (+) strand; PAM type: YTN; PAM sequence: TTA
ctaaatctgatgtaataaca

SEQ ID NO: 15341 - DNA, 20 bp, Artificial Sequence
  Description of Artificial Sequence: Synthetic oligonucleotide
  Target: ANGPTL3; (+) strand; PAM type: YTN; PAM sequence: CTA
aatctgatgtaataacattt

SEQ ID NO: 15342 - DNA, 20 bp, Artificial Sequence
  Description of Artificial Sequence: Synthetic oligonucleotide
  Target: ANGPTL3; (+) strand; PAM type: YTN; PAM sequence: CTG
atgtaataacattttattga

SEQ ID NO: 15343 - DNA, 20 bp, Artificial Sequence
  Description of Artificial Sequence: Synthetic oligonucleotide
  Target: ANGPTL3; (+) strand; PAM type: YTN; PAM sequence: TTT
tattgattctaggcattcct

SEQ ID NO: 15344 - DNA, 20 bp, Artificial Sequence
  Description of Artificial Sequence: Synthetic oligonucleotide
  Target: ANGPTL3; (+) strand; PAM type: YTN; PAM sequence: TTT
attgattctaggcattcctg

SEQ ID NO: 15345 - DNA, 20 bp, Artificial Sequence
  Description of Artificial Sequence: Synthetic oligonucleotide
  Target: ANGPTL3; (+) strand; PAM type: YTN; PAM sequence: TTA
ttgattctaggcattcctgc

SEQ ID NO: 15346 - DNA, 20 bp, Artificial Sequence
  Description of Artificial Sequence: Synthetic oligonucleotide
  Target: ANGPTL3; (+) strand; PAM type: YTN; PAM sequence: TTG
attctaggcattcctgctga

SEQ ID NO: 15347 - DNA, 20 bp, Artificial Sequence
  Description of Artificial Sequence: Synthetic oligonucleotide
  Target: ANGPTL3; (+) strand; PAM type: YTN; PAM sequence: TTC
taggcattcctgctgaatgt

SEQ ID NO: 15348 - DNA, 20 bp, Artificial Sequence
  Description of Artificial Sequence: Synthetic oligonucleotide
  Target: ANGPTL3; (+) strand; PAM type: YTN; PAM sequence: CTA
ggcattcctgctgaatgtac

SEQ ID NO: 15349 - DNA, 20 bp, Artificial Sequence
  Description of Artificial Sequence: Synthetic oligonucleotide
  Target: ANGPTL3; (+) strand; PAM type: YTN; PAM sequence: TTC
ctgctgaatgtaccaccatt

SEQ ID NO: 15350 - DNA, 20 bp, Artificial Sequence
  Description of Artificial Sequence: Synthetic oligonucleotide
  Target: ANGPTL3; (+) strand; PAM type: YTN; PAM sequence: CTG
ctgaatgtaccaccatttat

SEQ ID NO: 15351 - DNA, 20 bp, Artificial Sequence
  Description of Artificial Sequence: Synthetic oligonucleotide
  Target: ANGPTL3; (+) strand; PAM type: YTN; PAM sequence: CTG
aatgtaccaccatttataac

SEQ ID NO: 15352 - DNA, 20 bp, Artificial Sequence
  Description of Artificial Sequence: Synthetic oligonucleotide
  Target: ANGPTL3; (+) strand; PAM type: YTN; PAM sequence: TTT
ataacagaggtgaacataca

SEQ ID NO: 15353 - DNA, 20 bp, Artificial Sequence
  Description of Artificial Sequence: Synthetic oligonucleotide
  Target: ANGPTL3; (+) strand; PAM type: YTN; PAM sequence: TTA
taacagaggtgaacatacaa

SEQ ID NO: 15354 - DNA, 20 bp, Artificial Sequence
  Description of Artificial Sequence: Synthetic oligonucleotide
  Target: ANGPTL3; (+) strand; PAM type: YTN; PAM sequence: CTC
tcaagtttttcatgtctact

SEQ ID NO: 15355 - DNA, 20 bp, Artificial Sequence
  Description of Artificial Sequence: Synthetic oligonucleotide
  Target: ANGPTL3; (+) strand; PAM type: YTN; PAM sequence: CTC
aagtttttcatgtctactgt

SEQ ID NO: 15356 - DNA, 20 bp, Artificial Sequence
  Description of Artificial Sequence: Synthetic oligonucleotide
  Target: ANGPTL3; (+) strand; PAM type: YTN; PAM sequence: TTT
ttcatgtctactgtgatgtt

SEQ ID NO: 15357 - DNA, 20 bp, Artificial Sequence
  Description of Artificial Sequence: Synthetic oligonucleotide
  Target: ANGPTL3; (+) strand; PAM type: YTN; PAM sequence: TTT
tcatgtctactgtgatgtta

SEQ ID NO: 15358 - DNA, 20 bp, Artificial Sequence
  Description of Artificial Sequence: Synthetic oligonucleotide
  Target: ANGPTL3; (+) strand; PAM type: YTN; PAM sequence: TTT
catgtctactgtgatgttat

SEQ ID NO: 15359 - DNA, 20 bp, Artificial Sequence
  Description of Artificial Sequence: Synthetic oligonucleotide
  Target: ANGPTL3; (+) strand; PAM type: YTN; PAM sequence: TTC
atgtctactgtgatgttata

SEQ ID NO: 15360 - DNA, 20 bp, Artificial Sequence
  Description of Artificial Sequence: Synthetic oligonucleotide
  Target: ANGPTL3; (+) strand; PAM type: YTN; PAM sequence: CTA
ctgtgatgttatatcaggta

SEQ ID NO: 15361 - DNA, 20 bp, Artificial Sequence
  Description of Artificial Sequence: Synthetic oligonucleotide
  Target: ANGPTL3; (+) strand; PAM type: YTN; PAM sequence: CTG
tgatgttatatcaggtaaaa

SEQ ID NO: 15362 - DNA, 20 bp, Artificial Sequence
  Description of Artificial Sequence: Synthetic oligonucleotide
  Target: ANGPTL3; (+) strand; PAM type: YTN; PAM sequence: TTA
tatcaggtaaaacctgtcta

SEQ ID NO: 15363 - DNA, 20 bp, Artificial Sequence
  Description of Artificial Sequence: Synthetic oligonucleotide
  Target: ANGPTL3; (+) strand; PAM type: YTN; PAM sequence: CTG
tctaaggagaatagacagta

SEQ ID NO: 15364 - DNA, 20 bp, Artificial Sequence
  Description of Artificial Sequence: Synthetic oligonucleotide
  Target: ANGPTL3; (+) strand; PAM type: YTN; PAM sequence: CTA
aggagaatagacagtagtta

SEQ ID NO: 15365 - DNA, 20 bp, Artificial Sequence
  Description of Artificial Sequence: Synthetic oligonucleotide
  Target: ANGPTL3; (+) strand; PAM type: YTN; PAM sequence: TTA
gttcaacttactcattacgt

SEQ ID NO: 15366 - DNA, 20 bp, Artificial Sequence
  Description of Artificial Sequence: Synthetic oligonucleotide
  Target: ANGPTL3; (+) strand; PAM type: YTN; PAM sequence: TTC
aacttactcattacgtatta

SEQ ID NO: 15367 - DNA, 20 bp, Artificial Sequence
  Description of Artificial Sequence: Synthetic oligonucleotide
  Target: ANGPTL3; (+) strand; PAM type: YTN; PAM sequence: CTT
actcattacgtattaggaag

SEQ ID NO: 15368 - DNA, 20 bp, Artificial Sequence
  Description of Artificial Sequence: Synthetic oligonucleotide
  Target: ANGPTL3; (+) strand; PAM type: YTN; PAM sequence: TTA
ctcattacgtattaggaaga

SEQ ID NO: 15369 - DNA, 20 bp, Artificial Sequence
  Description of Artificial Sequence: Synthetic oligonucleotide
  Target: ANGPTL3; (+) strand; PAM type: YTN; PAM sequence: CTC
attacgtattaggaagatta

SEQ ID NO: 15370 - DNA, 20 bp, Artificial Sequence
  Description of Artificial Sequence: Synthetic oligonucleotide
  Target: ANGPTL3; (+) strand; PAM type: YTN; PAM sequence: TTA
cgtattaggaagattaacct

SEQ ID NO: 15371 - DNA, 20 bp, Artificial Sequence
  Description of Artificial Sequence: Synthetic oligonucleotide
  Target: ANGPTL3; (+) strand; PAM type: YTN; PAM sequence: TTA
ggaagattaacctggttatc

SEQ ID NO: 15372 - DNA, 20 bp, Artificial Sequence
  Description of Artificial Sequence: Synthetic oligonucleotide
  Target: ANGPTL3; (+) strand; PAM type: YTN; PAM sequence: TTA
acctggttatcattgtttta

SEQ ID NO: 15373 - DNA, 20 bp, Artificial Sequence
  Description of Artificial Sequence: Synthetic oligonucleotide
  Target: ANGPTL3; (+) strand; PAM type: YTN; PAM sequence: CTG
gttatcattgttttatacat

SEQ ID NO: 15374 - DNA, 20 bp, Artificial Sequence
  Description of Artificial Sequence: Synthetic oligonucleotide
  Target: ANGPTL3; (+) strand; PAM type: YTN; PAM sequence: TTA
tcattgttttatacatatat

SEQ ID NO: 15375 - DNA, 20 bp, Artificial Sequence
  Description of Artificial Sequence: Synthetic oligonucleotide
  Target: ANGPTL3; (+) strand; PAM type: YTN; PAM sequence: TTG
ttttatacatatatatatga

SEQ ID NO: 15376 - DNA, 20 bp, Artificial Sequence
  Description of Artificial Sequence: Synthetic oligonucleotide
  Target: ANGPTL3; (+) strand; PAM type: YTN; PAM sequence: TTT
tatacatatatatatgaaat

SEQ ID NO: 15377 - DNA, 20 bp, Artificial Sequence
  Description of Artificial Sequence: Synthetic oligonucleotide
  Target: ANGPTL3; (+) strand; PAM type: YTN; PAM sequence: TTT
atacatatatatatgaaata

SEQ ID NO: 15378 - DNA, 20 bp, Artificial Sequence
  Description of Artificial Sequence: Synthetic oligonucleotide
  Target: ANGPTL3; (+) strand; PAM type: YTN; PAM sequence: TTA
tacatatatatatgaaatat

SEQ ID NO: 15379 - DNA, 20 bp, Artificial Sequence
  Description of Artificial Sequence: Synthetic oligonucleotide
  Target: ANGPTL3; (+) strand; PAM type: YTN; PAM sequence: TTC
gtataaatataatactttta

SEQ ID NO: 15380 - DNA, 20 bp, Artificial Sequence
  Description of Artificial Sequence: Synthetic oligonucleotide
  Target: ANGPTL3; (+) strand; PAM type: YTN; PAM sequence: CTT
ttaccttgtttatgtattta

SEQ ID NO: 15381 - DNA, 20 bp, Artificial Sequence
  Description of Artificial Sequence: Synthetic oligonucleotide
  Target: ANGPTL3; (+) strand; PAM type: YTN; PAM sequence: TTT
taccttgtttatgtatttac

SEQ ID NO: 15382 - DNA, 20 bp, Artificial Sequence
  Description of Artificial Sequence: Synthetic oligonucleotide
  Target: ANGPTL3; (+) strand; PAM type: YTN; PAM sequence: TTT
accttgtttatgtatttact

SEQ ID NO: 15383 - DNA, 20 bp, Artificial Sequence
  Description of Artificial Sequence: Synthetic oligonucleotide
  Target: ANGPTL3; (+) strand; PAM type: YTN; PAM sequence: TTA
ccttgtttatgtatttactc

SEQ ID NO: 15384 - DNA, 20 bp, Artificial Sequence
  Description of Artificial Sequence: Synthetic oligonucleotide
  Target: ANGPTL3; (+) strand; PAM type: YTN; PAM sequence: CTT
gtttatgtatttactcaata

SEQ ID NO: 15385 - DNA, 20 bp, Artificial Sequence
  Description of Artificial Sequence: Synthetic oligonucleotide
  Target: ANGPTL3; (+) strand; PAM type: YTN; PAM sequence: TTG
tttatgtatttactcaatat

SEQ ID NO: 15386 - DNA, 20 bp, Artificial Sequence
  Description of Artificial Sequence: Synthetic oligonucleotide
  Target: ANGPTL3; (+) strand; PAM type: YTN; PAM sequence: TTT
atgtatttactcaatattct

SEQ ID NO: 15387 - DNA, 20 bp, Artificial Sequence
  Description of Artificial Sequence: Synthetic oligonucleotide
  Target: ANGPTL3; (+) strand; PAM type: YTN; PAM sequence: TTA
tgtatttactcaatattctc

SEQ ID NO: 15388 - DNA, 20 bp, Artificial Sequence
  Description of Artificial Sequence: Synthetic oligonucleotide
  Target: ANGPTL3; (+) strand; PAM type: YTN; PAM sequence: TTT
actcaatattctccttttcc

SEQ ID NO: 15389 - DNA, 20 bp, Artificial Sequence
  Description of Artificial Sequence: Synthetic oligonucleotide
  Target: ANGPTL3; (+) strand; PAM type: YTN; PAM sequence: TTA
ctcaatattctccttttcct

SEQ ID NO: 15390 - DNA, 20 bp, Artificial Sequence
  Description of Artificial Sequence: Synthetic oligonucleotide
  Target: ANGPTL3; (+) strand; PAM type: YTN; PAM sequence: CTC
aatattctccttttcctcta

SEQ ID NO: 15391 - DNA, 20 bp, Artificial Sequence
  Description of Artificial Sequence: Synthetic oligonucleotide
  Target: ANGPTL3; (+) strand; PAM type: YTN; PAM sequence: TTC
tccttttcctctaaaataat

SEQ ID NO: 15392 - DNA, 20 bp, Artificial Sequence
  Description of Artificial Sequence: Synthetic oligonucleotide
  Target: ANGPTL3; (+) strand; PAM type: YTN; PAM sequence: CTC
cttttcctctaaaataatct

SEQ ID NO: 15393 - DNA, 20 bp, Artificial Sequence
  Description of Artificial Sequence: Synthetic oligonucleotide
  Target: ANGPTL3; (+) strand; PAM type: YTN; PAM sequence: CTT
ttcctctaaaataatctgaa

SEQ ID NO: 15394 - DNA, 20 bp, Artificial Sequence
  Description of Artificial Sequence: Synthetic oligonucleotide
  Target: ANGPTL3; (+) strand; PAM type: YTN; PAM sequence: TTT
tcctctaaaataatctgaag

SEQ ID NO: 15395 - DNA, 20 bp, Artificial Sequence
  Description of Artificial Sequence: Synthetic oligonucleotide
  Target: ANGPTL3; (+) strand; PAM type: YTN; PAM sequence: TTT
cctctaaaataatctgaagt

SEQ ID NO: 15396 - DNA, 20 bp, Artificial Sequence
  Description of Artificial Sequence: Synthetic oligonucleotide
  Target: ANGPTL3; (+) strand; PAM type: YTN; PAM sequence: TTC
ctctaaaataatctgaagtg

SEQ ID NO: 15397 - DNA, 20 bp, Artificial Sequence
  Description of Artificial Sequence: Synthetic oligonucleotide
  Target: ANGPTL3; (+) strand; PAM type: YTN; PAM sequence: CTC
taaaataatctgaagtgact

SEQ ID NO: 15398 - DNA, 20 bp, Artificial Sequence
  Description of Artificial Sequence: Synthetic oligonucleotide
  Target: ANGPTL3; (+) strand; PAM type: YTN; PAM sequence: CTA
aaataatctgaagtgactat

SEQ ID NO: 15399 - DNA, 20 bp, Artificial Sequence
  Description of Artificial Sequence: Synthetic oligonucleotide
  Target: ANGPTL3; (+) strand; PAM type: YTN; PAM sequence: CTG
aagtgactattatcaataag

SEQ ID NO: 15400 - DNA, 20 bp, Artificial Sequence
  Description of Artificial Sequence: Synthetic oligonucleotide
  Target: ANGPTL3; (+) strand; PAM type: YTN; PAM sequence: CTA
ttatcaataagtttactatg

SEQ ID NO: 15401 - DNA, 20 bp, Artificial Sequence
  Description of Artificial Sequence: Synthetic oligonucleotide
  Target: ANGPTL3; (+) strand; PAM type: YTN; PAM sequence: TTA
tcaataagtttactatgcca

SEQ ID NO: 15402 - DNA, 20 bp, Artificial Sequence
  Description of Artificial Sequence: Synthetic oligonucleotide
  Target: ANGPTL3; (+) strand; PAM type: YTN; PAM sequence: TTT
actatgccaaaattcattaa

SEQ ID NO: 15403 - DNA, 20 bp, Artificial Sequence
  Description of Artificial Sequence: Synthetic oligonucleotide
  Target: ANGPTL3; (+) strand; PAM type: YTN; PAM sequence: TTA
ctatgccaaaattcattaat

SEQ ID NO: 15404 - DNA, 20 bp, Artificial Sequence
  Description of Artificial Sequence: Synthetic oligonucleotide
  Target: ANGPTL3; (+) strand; PAM type: YTN; PAM sequence: CTA
tgccaaaattcattaattgc

SEQ ID NO: 15405 - DNA, 20 bp, Artificial Sequence
  Description of Artificial Sequence: Synthetic oligonucleotide
  Target: ANGPTL3; (+) strand; PAM type: YTN; PAM sequence: TTC
attaattgcctttcacttaa

SEQ ID NO: 15406 - DNA, 20 bp, Artificial Sequence
  Description of Artificial Sequence: Synthetic oligonucleotide
  Target: ANGPTL3; (+) strand; PAM type: YTN; PAM sequence: TTA
attgcctttcacttaacttt

SEQ ID NO: 15407 - DNA, 20 bp, Artificial Sequence
  Description of Artificial Sequence: Synthetic oligonucleotide
  Target: ANGPTL3; (+) strand; PAM type: YTN; PAM sequence: TTG
cctttcacttaacttttggg

SEQ ID NO: 15408 - DNA, 20 bp, Artificial Sequence
  Description of Artificial Sequence: Synthetic oligonucleotide
  Target: ANGPTL3; (+) strand; PAM type: YTN; PAM sequence: CTT
tcacttaacttttgggacca

SEQ ID NO: 15409 - DNA, 20 bp, Artificial Sequence
  Description of Artificial Sequence: Synthetic oligonucleotide
  Target: ANGPTL3; (+) strand; PAM type: YTN; PAM sequence: TTT
cacttaacttttgggaccat

SEQ ID NO: 15410 - DNA, 20 bp, Artificial Sequence
  Description of Artificial Sequence: Synthetic oligonucleotide
  Target: ANGPTL3; (+) strand; PAM type: YTN; PAM sequence: TTC
acttaacttttgggaccata

SEQ ID NO: 15411 - DNA, 20 bp, Artificial Sequence
  Description of Artificial Sequence: Synthetic oligonucleotide
  Target: ANGPTL3; (+) strand; PAM type: YTN; PAM sequence: CTT
aacttttgggaccataataa

SEQ ID NO: 15412 - DNA, 20 bp, Artificial Sequence
  Description of Artificial Sequence: Synthetic oligonucleotide
  Target: ANGPTL3; (+) strand; PAM type: YTN; PAM sequence: TTA
acttttgggaccataataaa

SEQ ID NO: 15413 - DNA, 20 bp, Artificial Sequence
  Description of Artificial Sequence: Synthetic oligonucleotide
  Target: ANGPTL3; (+) strand; PAM type: YTN; PAM sequence: CTT
ttgggaccataataaataat

SEQ ID NO: 15414 - DNA, 20 bp, Artificial Sequence
  Description of Artificial Sequence: Synthetic oligonucleotide
  Target: ANGPTL3; (+) strand; PAM type: YTN; PAM sequence: TTT
tgggaccataataaataata

SEQ ID NO: 15415 - DNA, 20 bp, Artificial Sequence
  Description of Artificial Sequence: Synthetic oligonucleotide
  Target: ANGPTL3; (+) strand; PAM type: YTN; PAM sequence: TTT
gggaccataataaataataa

SEQ ID NO: 15416 - DNA, 20 bp, Artificial Sequence
  Description of Artificial Sequence: Synthetic oligonucleotide
  Target: ANGPTL3; (+) strand; PAM type: YTN; PAM sequence: TTG
ggaccataataaataataaa

SEQ ID NO: 15417 - DNA, 20 bp, Artificial Sequence
  Description of Artificial Sequence: Synthetic oligonucleotide
  Target: ANGPTL3; (+) strand; PAM type: YTN; PAM sequence: TTG
ccataacattaataaactac

SEQ ID NO: 15418 - DNA, 20 bp, Artificial Sequence
  Description of Artificial Sequence: Synthetic oligonucleotide
  Target: ANGPTL3; (+) strand; PAM type: YTN; PAM sequence: TTA
ataaactaccttacaaaacc

SEQ ID NO: 15419 - DNA, 20 bp, Artificial Sequence
  Description of Artificial Sequence: Synthetic oligonucleotide
  Target: ANGPTL3; (+) strand; PAM type: YTN; PAM sequence: CTA
ccttacaaaaccaccaatta

SEQ ID NO: 15420 - DNA, 20 bp, Artificial Sequence
  Description of Artificial Sequence: Synthetic oligonucleotide
  Target: ANGPTL3; (+) strand; PAM type: YTN; PAM sequence: CTT
acaaaaccaccaattaaaat

SEQ ID NO: 15421 - DNA, 20 bp, Artificial Sequence
  Description of Artificial Sequence: Synthetic oligonucleotide
  Target: ANGPTL3; (+) strand; PAM type: YTN; PAM sequence: TTA
caaaaccaccaattaaaatc

SEQ ID NO: 15422 - DNA, 20 bp, Artificial Sequence
  Description of Artificial Sequence: Synthetic oligonucleotide
  Target: ANGPTL3; (+) strand; PAM type: YTN; PAM sequence: TTA
aaatcaaacaaacaaaaaag

SEQ ID NO: 15423 - DNA, 20 bp, Artificial Sequence
  Description of Artificial Sequence: Synthetic oligonucleotide
  Target: ANGPTL3; (+) strand; PAM type: YTN; PAM sequence: TTA
tttacatctgtcaacataaa

SEQ ID NO: 15424 - DNA, 20 bp, Artificial Sequence
  Description of Artificial Sequence: Synthetic oligonucleotide
  Target: ANGPTL3; (+) strand; PAM type: YTN; PAM sequence: TTT
acatctgtcaacataaatct

SEQ ID NO: 15425 - DNA, 20 bp, Artificial Sequence
  Description of Artificial Sequence: Synthetic oligonucleotide
  Target: ANGPTL3; (+) strand; PAM type: YTN; PAM sequence: TTA
catctgtcaacataaatcta

SEQ ID NO: 15426 - DNA, 20 bp, Artificial Sequence
  Description of Artificial Sequence: Synthetic oligonucleotide
  Target: ANGPTL3; (+) strand; PAM type: YTN; PAM sequence: CTG
tcaacataaatctactaaaa

SEQ ID NO: 15427 - DNA, 20 bp, Artificial Sequence
  Description of Artificial Sequence: Synthetic oligonucleotide
  Target: ANGPTL3; (+) strand; PAM type: YTN; PAM sequence: CTA
ctaaaaatacatgatttcat

SEQ ID NO: 15428 - DNA, 20 bp, Artificial Sequence
  Description of Artificial Sequence: Synthetic oligonucleotide
  Target: ANGPTL3; (+) strand; PAM type: YTN; PAM sequence: CTA
aaaatacatgatttcattca

SEQ ID NO: 15429 - DNA, 20 bp, Artificial Sequence
  Description of Artificial Sequence: Synthetic oligonucleotide
  Target: ANGPTL3; (+) strand; PAM type: YTN; PAM sequence: TTT
cattcattatattcaggtag

SEQ ID NO: 15430 - DNA, 20 bp, Artificial Sequence
  Description of Artificial Sequence: Synthetic oligonucleotide
  Target: ANGPTL3; (+) strand; PAM type: YTN; PAM sequence: TTC
attcattatattcaggtagt

SEQ ID NO: 15431 - DNA, 20 bp, Artificial Sequence
  Description of Artificial Sequence: Synthetic oligonucleotide
  Target: ANGPTL3; (+) strand; PAM type: YTN; PAM sequence: TTC
attatattcaggtagtccat

SEQ ID NO: 15432 - DNA, 20 bp, Artificial Sequence
  Description of Artificial Sequence: Synthetic oligonucleotide
  Target: ANGPTL3; (+) strand; PAM type: YTN; PAM sequence: TTA
tattcaggtagtccatggac

SEQ ID NO: 15433 - DNA, 20 bp, Artificial Sequence
  Description of Artificial Sequence: Synthetic oligonucleotide
  Target: ANGPTL3; (+) strand; PAM type: YTN; PAM sequence: TTC
aggtagtccatggacattaa

SEQ ID NO: 15434 - DNA, 20 bp, Artificial Sequence
  Description of Artificial Sequence: Synthetic oligonucleotide
  Target: ANGPTL3; (+) strand; PAM type: YTN; PAM sequence: TTA
attcaacatcgaatagatgg

SEQ ID NO: 15435 - DNA, 20 bp, Artificial Sequence
  Description of Artificial Sequence: Synthetic oligonucleotide
  Target: ANGPTL3; (+) strand; PAM type: YTN; PAM sequence: TTC
aacatcgaatagatggatca

SEQ ID NO: 15436 - DNA, 20 bp, Artificial Sequence
  Description of Artificial Sequence: Synthetic oligonucleotide
  Target: ANGPTL3; (+) strand; PAM type: YTN; PAM sequence: CTT
caatgaaacgtgggagaact

SEQ ID NO: 15437 - DNA, 20 bp, Artificial Sequence
  Description of Artificial Sequence: Synthetic oligonucleotide
  Target: ANGPTL3; (+) strand; PAM type: YTN; PAM sequence: TTC
aatgaaacgtgggagaacta

SEQ ID NO: 15438 - DNA, 20 bp, Artificial Sequence
  Description of Artificial Sequence: Synthetic oligonucleotide
  Target: ANGPTL3; (+) strand; PAM type: YTN; PAM sequence: CTA
caaatatggttttgggaggc

SEQ ID NO: 15439 - DNA, 20 bp, Artificial Sequence
  Description of Artificial Sequence: Synthetic oligonucleotide
  Target: ANGPTL3; (+) strand; PAM type: YTN; PAM sequence: TTT
tgggaggcttgatggtaagg

SEQ ID NO: 15440 - DNA, 20 bp, Artificial Sequence
  Description of Artificial Sequence: Synthetic oligonucleotide
  Target: ANGPTL3; (+) strand; PAM type: YTN; PAM sequence: TTT
gggaggcttgatggtaaggg

SEQ ID NO: 15441 - DNA, 20 bp, Artificial Sequence
  Description of Artificial Sequence: Synthetic oligonucleotide
  Target: ANGPTL3; (+) strand; PAM type: YTN; PAM sequence: TTG
ggaggcttgatggtaagggg

SEQ ID NO: 15442 - DNA, 20 bp, Artificial Sequence
  Description of Artificial Sequence: Synthetic oligonucleotide
  Target: ANGPTL3; (+) strand; PAM type: YTN; PAM sequence: CTT
gatggtaaggggactacatt

SEQ ID NO: 15443 - DNA, 20 bp, Artificial Sequence
  Description of Artificial Sequence: Synthetic oligonucleotide
  Target: ANGPTL3; (+) strand; PAM type: YTN; PAM sequence: TTG
atggtaaggggactacattc

SEQ ID NO: 15444 - DNA, 20 bp, Artificial Sequence
  Description of Artificial Sequence: Synthetic oligonucleotide
  Target: ANGPTL3; (+) strand; PAM type: YTN; PAM sequence: CTA
cattcaatcattcattcact

SEQ ID NO: 15445 - DNA, 20 bp, Artificial Sequence
  Description of Artificial Sequence: Synthetic oligonucleotide
  Target: ANGPTL3; (+) strand; PAM type: YTN; PAM sequence: TTC
aatcattcattcacttgcta

SEQ ID NO: 15446 - DNA, 20 bp, Artificial Sequence
  Description of Artificial Sequence: Synthetic oligonucleotide
  Target: ANGPTL3; (+) strand; PAM type: YTN; PAM sequence: TTC
attcacttgctaatctacaa

SEQ ID NO: 15447 - DNA, 20 bp, Artificial Sequence
  Description of Artificial Sequence: Synthetic oligonucleotide
  Target: ANGPTL3; (+) strand; PAM type: YTN; PAM sequence: TTC
acttgctaatctacaaatat

SEQ ID NO: 15448 - DNA, 20 bp, Artificial Sequence
  Description of Artificial Sequence: Synthetic oligonucleotide
  Target: ANGPTL3; (+) strand; PAM type: YTN; PAM sequence: CTT
gctaatctacaaatatttac

SEQ ID NO: 15449 - DNA, 20 bp, Artificial Sequence
  Description of Artificial Sequence: Synthetic oligonucleotide
  Target: ANGPTL3; (+) strand; PAM type: YTN; PAM sequence: TTG
ctaatctacaaatatttact

SEQ ID NO: 15450 - DNA, 20 bp, Artificial Sequence
  Description of Artificial Sequence: Synthetic oligonucleotide
  Target: ANGPTL3; (+) strand; PAM type: YTN; PAM sequence: CTA
atctacaaatatttactgag

SEQ ID NO: 15451 - DNA, 20 bp, Artificial Sequence
  Description of Artificial Sequence: Synthetic oligonucleotide
  Target: ANGPTL3; (+) strand; PAM type: YTN; PAM sequence: CTA
caaatatttactgagaacct

SEQ ID NO: 15452 - DNA, 20 bp, Artificial Sequence
  Description of Artificial Sequence: Synthetic oligonucleotide
  Target: ANGPTL3; (+) strand; PAM type: YTN; PAM sequence: TTT
actgagaacctcttatggac

SEQ ID NO: 15453 - DNA, 20 bp, Artificial Sequence
  Description of Artificial Sequence: Synthetic oligonucleotide
  Target: ANGPTL3; (+) strand; PAM type: YTN; PAM sequence: TTA
ctgagaacctcttatggacc

SEQ ID NO: 15454 - DNA, 20 bp, Artificial Sequence
  Description of Artificial Sequence: Synthetic oligonucleotide
  Target: ANGPTL3; (+) strand; PAM type: YTN; PAM sequence: CTG
agaacctcttatggaccagg

SEQ ID NO: 15455 - DNA, 20 bp, Artificial Sequence
  Description of Artificial Sequence: Synthetic oligonucleotide
  Target: ANGPTL3; (+) strand; PAM type: YTN; PAM sequence: CTC
ttatggaccaggtattagga

SEQ ID NO: 15456 - DNA, 20 bp, Artificial Sequence
  Description of Artificial Sequence: Synthetic oligonucleotide
  Target: ANGPTL3; (+) strand; PAM type: YTN; PAM sequence: CTT
atggaccaggtattaggaaa

SEQ ID NO: 15457 - DNA, 20 bp, Artificial Sequence
  Description of Artificial Sequence: Synthetic oligonucleotide
  Target: ANGPTL3; (+) strand; PAM type: YTN; PAM sequence: TTA
tggaccaggtattaggaaaa

SEQ ID NO: 15458 - DNA, 20 bp, Artificial Sequence
  Description of Artificial Sequence: Synthetic oligonucleotide
  Target: ANGPTL3; (+) strand; PAM type: YTN; PAM sequence: TTA
ggaaaagtagtaacgaacga

SEQ ID NO: 15459 - DNA, 20 bp, Artificial Sequence
  Description of Artificial Sequence: Synthetic oligonucleotide
  Target: ANGPTL3; (+) strand; PAM type: YTN; PAM sequence: CTC
agccttcatataatttatta

SEQ ID NO: 15460 - DNA, 20 bp, Artificial Sequence
  Description of Artificial Sequence: Synthetic oligonucleotide
  Target: ANGPTL3; (+) strand; PAM type: YTN; PAM sequence: CTT
catataatttattatcaaac

SEQ ID NO: 15461 - DNA, 20 bp, Artificial Sequence
  Description of Artificial Sequence: Synthetic oligonucleotide
  Target: ANGPTL3; (+) strand; PAM type: YTN; PAM sequence: TTC
atataatttattatcaaaca

SEQ ID NO: 15462 - DNA, 20 bp, Artificial Sequence
  Description of Artificial Sequence: Synthetic oligonucleotide
  Target: ANGPTL3; (+) strand; PAM type: YTN; PAM sequence: TTT
attatcaaacaattacacat

SEQ ID NO: 15463 - DNA, 20 bp, Artificial Sequence
  Description of Artificial Sequence: Synthetic oligonucleotide
  Target: ANGPTL3; (+) strand; PAM type: YTN; PAM sequence: TTA
ttatcaaacaattacacatt

SEQ ID NO: 15464 - DNA, 20 bp, Artificial Sequence
  Description of Artificial Sequence: Synthetic oligonucleotide
  Target: ANGPTL3; (+) strand; PAM type: YTN; PAM sequence: TTA
tcaaacaattacacatttgt

SEQ ID NO: 15465 - DNA, 20 bp, Artificial Sequence
  Description of Artificial Sequence: Synthetic oligonucleotide
  Target: ANGPTL3; (+) strand; PAM type: YTN; PAM sequence: TTA
cacatttgttagtaaattac

SEQ ID NO: 15466 - DNA, 20 bp, Artificial Sequence
  Description of Artificial Sequence: Synthetic oligonucleotide
  Target: ANGPTL3; (+) strand; PAM type: YTN; PAM sequence: TTT
gttagtaaattacacttatt

SEQ ID NO: 15467 - DNA, 20 bp, Artificial Sequence
  Description of Artificial Sequence: Synthetic oligonucleotide
  Target: ANGPTL3; (+) strand; PAM type: YTN; PAM sequence: TTG
ttagtaaattacacttatta

SEQ ID NO: 15468 - DNA, 20 bp, Artificial Sequence
  Description of Artificial Sequence: Synthetic oligonucleotide
  Target: ANGPTL3; (+) strand; PAM type: YTN; PAM sequence: TTA
gtaaattacacttattacaa

SEQ ID NO: 15469 - DNA, 20 bp, Artificial Sequence
  Description of Artificial Sequence: Synthetic oligonucleotide
  Target: ANGPTL3; (+) strand; PAM type: YTN; PAM sequence: TTA
cacttattacaactgttatt

SEQ ID NO: 15470 - DNA, 20 bp, Artificial Sequence
  Description of Artificial Sequence: Synthetic oligonucleotide
  Target: ANGPTL3; (+) strand; PAM type: YTN; PAM sequence: CTT
attacaactgttattatttg

SEQ ID NO: 15471 - DNA, 20 bp, Artificial Sequence
  Description of Artificial Sequence: Synthetic oligonucleotide
  Target: ANGPTL3; (+) strand; PAM type: YTN; PAM sequence: TTA
ttacaactgttattatttga

SEQ ID NO: 15472 - DNA, 20 bp, Artificial Sequence
  Description of Artificial Sequence: Synthetic oligonucleotide
  Target: ANGPTL3; (+) strand; PAM type: YTN; PAM sequence: TTA
caactgttattatttgaatt

SEQ ID NO: 15473 - DNA, 20 bp, Artificial Sequence
  Description of Artificial Sequence: Synthetic oligonucleotide
  Target: ANGPTL3; (+) strand; PAM type: YTN; PAM sequence: CTG
ttattatttgaattatattt

SEQ ID NO: 15474 - DNA, 20 bp, Artificial Sequence
  Description of Artificial Sequence: Synthetic oligonucleotide
  Target: ANGPTL3; (+) strand; PAM type: YTN; PAM sequence: TTA
ttatttgaattatatttatc

SEQ ID NO: 15475 - DNA, 20 bp, Artificial Sequence
  Description of Artificial Sequence: Synthetic oligonucleotide
  Target: ANGPTL3; (+) strand; PAM type: YTN; PAM sequence: TTA
tttgaattatatttatcaca

SEQ ID NO: 15476 - DNA, 20 bp, Artificial Sequence
  Description of Artificial Sequence: Synthetic oligonucleotide
  Target: ANGPTL3; (+) strand; PAM type: YTN; PAM sequence: TTT
gaattatatttatcacaatt

SEQ ID NO: 15477 - DNA, 20 bp, Artificial Sequence
  Description of Artificial Sequence: Synthetic oligonucleotide
  Target: ANGPTL3; (+) strand; PAM type: YTN; PAM sequence: TTG
aattatatttatcacaatta

SEQ ID NO: 15478 - DNA, 20 bp, Artificial Sequence
  Description of Artificial Sequence: Synthetic oligonucleotide
  Target: ANGPTL3; (+) strand; PAM type: YTN; PAM sequence: TTA
tatttatcacaattacatgt

SEQ ID NO: 15479 - DNA, 20 bp, Artificial Sequence
  Description of Artificial Sequence: Synthetic oligonucleotide
  Target: ANGPTL3; (+) strand; PAM type: YTN; PAM sequence: TTT
atcacaattacatgtctgtt

SEQ ID NO: 15480 - DNA, 20 bp, Artificial Sequence
  Description of Artificial Sequence: Synthetic oligonucleotide
  Target: ANGPTL3; (+) strand; PAM type: YTN; PAM sequence: TTA
tcacaattacatgtctgttc

SEQ ID NO: 15481 - DNA, 20 bp, Artificial Sequence
  Description of Artificial Sequence: Synthetic oligonucleotide
  Target: ANGPTL3; (+) strand; PAM type: YTN; PAM sequence: TTA
catgtctgttcttaaatata

SEQ ID NO: 15482 - DNA, 20 bp, Artificial Sequence
  Description of Artificial Sequence: Synthetic oligonucleotide
  Target: ANGPTL3; (+) strand; PAM type: YTN; PAM sequence: CTG
ttcttaaatatacttatcac

SEQ ID NO: 15483 - DNA, 20 bp, Artificial Sequence
  Description of Artificial Sequence: Synthetic oligonucleotide
  Target: ANGPTL3; (+) strand; PAM type: YTN; PAM sequence: TTC
ttaaatatacttatcacaat

SEQ ID NO: 15484 - DNA, 20 bp, Artificial Sequence
  Description of Artificial Sequence: Synthetic oligonucleotide
  Target: ANGPTL3; (+) strand; PAM type: YTN; PAM sequence: CTT
aaatatacttatcacaattt

SEQ ID NO: 15485 - DNA, 20 bp, Artificial Sequence
  Description of Artificial Sequence: Synthetic oligonucleotide
  Target: ANGPTL3; (+) strand; PAM type: YTN; PAM sequence: TTA
aatatacttatcacaattta

SEQ ID NO: 15486 - DNA, 20 bp, Artificial Sequence
  Description of Artificial Sequence: Synthetic oligonucleotide
  Target: ANGPTL3; (+) strand; PAM type: YTN; PAM sequence: CTT
atcacaatttaattccacgg

SEQ ID NO: 15487 - DNA, 20 bp, Artificial Sequence
  Description of Artificial Sequence: Synthetic oligonucleotide
  Target: ANGPTL3; (+) strand; PAM type: YTN; PAM sequence: TTA
tcacaatttaattccacggc

SEQ ID NO: 15488 - DNA, 20 bp, Artificial Sequence
  Description of Artificial Sequence: Synthetic oligonucleotide
  Target: ANGPTL3; (+) strand; PAM type: YTN; PAM sequence: TTT
aattccacggcttacaatga

SEQ ID NO: 15489 - DNA, 20 bp, Artificial Sequence
  Description of Artificial Sequence: Synthetic oligonucleotide
  Target: ANGPTL3; (+) strand; PAM type: YTN; PAM sequence: TTA
attccacggcttacaatgat

SEQ ID NO: 15490 - DNA, 20 bp, Artificial Sequence
  Description of Artificial Sequence: Synthetic oligonucleotide
  Target: ANGPTL3; (+) strand; PAM type: YTN; PAM sequence: TTC
cacggcttacaatgatcata

SEQ ID NO: 15491 - DNA, 20 bp, Artificial Sequence
  Description of Artificial Sequence: Synthetic oligonucleotide
  Target: ANGPTL3; (+) strand; PAM type: YTN; PAM sequence: CTT
acaatgatcataactataat

SEQ ID NO: 15492 - DNA, 20 bp, Artificial Sequence
  Description of Artificial Sequence: Synthetic oligonucleotide
  Target: ANGPTL3; (+) strand; PAM type: YTN; PAM sequence: TTA
caatgatcataactataatt

SEQ ID NO: 15493 - DNA, 20 bp, Artificial Sequence
  Description of Artificial Sequence: Synthetic oligonucleotide
  Target: ANGPTL3; (+) strand; PAM type: YTN; PAM sequence: CTA
taattattaaagacaatttt

SEQ ID NO: 15494 - DNA, 20 bp, Artificial Sequence
  Description of Artificial Sequence: Synthetic oligonucleotide
  Target: ANGPTL3; (+) strand; PAM type: YTN; PAM sequence: TTA
ttaaagacaattttgattaa

SEQ ID NO: 15495 - DNA, 20 bp, Artificial Sequence
  Description of Artificial Sequence: Synthetic oligonucleotide
  Target: ANGPTL3; (+) strand; PAM type: YTN; PAM sequence: TTA
aagacaattttgattaaatg

SEQ ID NO: 15496 - DNA, 20 bp, Artificial Sequence
  Description of Artificial Sequence: Synthetic oligonucleotide
  Target: ANGPTL3; (+) strand; PAM type: YTN; PAM sequence: TTT
tgattaaatgttatgtcata

SEQ ID NO: 15497 - DNA, 20 bp, Artificial Sequence
  Description of Artificial Sequence: Synthetic oligonucleotide
  Target: ANGPTL3; (+) strand; PAM type: YTN; PAM sequence: TTT
gattaaatgttatgtcataa

SEQ ID NO: 15498 - DNA, 20 bp, Artificial Sequence
  Description of Artificial Sequence: Synthetic oligonucleotide
  Target: ANGPTL3; (+) strand; PAM type: YTN; PAM sequence: TTG
attaaatgttatgtcataag

SEQ ID NO: 15499 - DNA, 20 bp, Artificial Sequence
  Description of Artificial Sequence: Synthetic oligonucleotide
  Target: ANGPTL3; (+) strand; PAM type: YTN; PAM sequence: TTA
aatgttatgtcataagtagt

SEQ ID NO: 15500 - DNA, 20 bp, Artificial Sequence
  Description of Artificial Sequence: Synthetic oligonucleotide
  Target: ANGPTL3; (+) strand; PAM type: YTN; PAM sequence: TTA
tgtcataagtagtaactgtt

SEQ ID NO: 15501 - DNA, 20 bp, Artificial Sequence
  Description of Artificial Sequence: Synthetic oligonucleotide
  Target: ANGPTL3; (+) strand; PAM type: YTN; PAM sequence: CTG
ttacaaataagctgtgaaaa

SEQ ID NO: 15502 - DNA, 20 bp, Artificial Sequence
  Description of Artificial Sequence: Synthetic oligonucleotide
  Target: ANGPTL3; (+) strand; PAM type: YTN; PAM sequence: TTA
caaataagctgtgaaaagaa

SEQ ID NO: 15503 - DNA, 20 bp, Artificial Sequence
  Description of Artificial Sequence: Synthetic oligonucleotide
  Target: ANGPTL3; (+) strand; PAM type: YTN; PAM sequence: CTG
tgaaaagaaccactcctagc

SEQ ID NO: 15504 - DNA, 20 bp, Artificial Sequence
  Description of Artificial Sequence: Synthetic oligonucleotide
  Target: ANGPTL3; (+) strand; PAM type: YTN; PAM sequence: CTC
ctagcattagtcactctatt

SEQ ID NO: 15505 - DNA, 20 bp, Artificial Sequence
  Description of Artificial Sequence: Synthetic oligonucleotide
  Target: ANGPTL3; (+) strand; PAM type: YTN; PAM sequence: CTA
gcattagtcactctattctc

SEQ ID NO: 15506 - DNA, 20 bp, Artificial Sequence
  Description of Artificial Sequence: Synthetic oligonucleotide
  Target: ANGPTL3; (+) strand; PAM type: YTN; PAM sequence: TTA
gtcactctattctctcatta

SEQ ID NO: 15507 - DNA, 20 bp, Artificial Sequence
  Description of Artificial Sequence: Synthetic oligonucleotide
  Target: ANGPTL3; (+) strand; PAM type: YTN; PAM sequence: CTC
tattctctcattaacgtttt

SEQ ID NO: 15508 - DNA, 20 bp, Artificial Sequence
  Description of Artificial Sequence: Synthetic oligonucleotide
  Target: ANGPTL3; (+) strand; PAM type: YTN; PAM sequence: CTA
ttctctcattaacgttttac

SEQ ID NO: 15509 - DNA, 20 bp, Artificial Sequence
  Description of Artificial Sequence: Synthetic oligonucleotide
  Target: ANGPTL3; (+) strand; PAM type: YTN; PAM sequence: TTC
tctcattaacgttttacata

SEQ ID NO: 15510 - DNA, 20 bp, Artificial Sequence
  Description of Artificial Sequence: Synthetic oligonucleotide
  Target: ANGPTL3; (+) strand; PAM type: YTN; PAM sequence: CTC
tcattaacgttttacatatc

SEQ ID NO: 15511 - DNA, 20 bp, Artificial Sequence
  Description of Artificial Sequence: Synthetic oligonucleotide
  Target: ANGPTL3; (+) strand; PAM type: YTN; PAM sequence: CTC
attaacgttttacatatcaa

SEQ ID NO: 15512 - DNA, 20 bp, Artificial Sequence
  Description of Artificial Sequence: Synthetic oligonucleotide
  Target: ANGPTL3; (+) strand; PAM type: YTN; PAM sequence: TTA
acgttttacatatcaattaa

SEQ ID NO: 15513 - DNA, 20 bp, Artificial Sequence
  Description of Artificial Sequence: Synthetic oligonucleotide
  Target: ANGPTL3; (+) strand; PAM type: YTN; PAM sequence: TTT
tacatatcaattaattggaa

SEQ ID NO: 15514 - DNA, 20 bp, Artificial Sequence
  Description of Artificial Sequence: Synthetic oligonucleotide
  Target: ANGPTL3; (+) strand; PAM type: YTN; PAM sequence: TTT
acatatcaattaattggaag

SEQ ID NO: 15515 - DNA, 20 bp, Artificial Sequence
  Description of Artificial Sequence: Synthetic oligonucleotide
  Target: ANGPTL3; (+) strand; PAM type: YTN; PAM sequence: TTA
catatcaattaattggaagt

SEQ ID NO: 15516 - DNA, 20 bp, Artificial Sequence
  Description of Artificial Sequence: Synthetic oligonucleotide
  Target: ANGPTL3; (+) strand; PAM type: YTN; PAM sequence: TTA
attggaagttaaaaggacca

SEQ ID NO: 15517 - DNA, 20 bp, Artificial Sequence
  Description of Artificial Sequence: Synthetic oligonucleotide
  Target: ANGPTL3; (+) strand; PAM type: YTN; PAM sequence: TTG
gaagttaaaaggaccaggaa

SEQ ID NO: 15518 - DNA, 20 bp, Artificial Sequence
  Description of Artificial Sequence: Synthetic oligonucleotide
  Target: ANGPTL3; (+) strand; PAM type: YTN; PAM sequence: TTA
aaaggaccaggaaactcaga

SEQ ID NO: 15519 - DNA, 20 bp, Artificial Sequence
  Description of Artificial Sequence: Synthetic oligonucleotide
  Target: ANGPTL3; (+) strand; PAM type: YTN; PAM sequence: CTC
agacatacagtatacatttt

SEQ ID NO: 15520 - DNA, 20 bp, Artificial Sequence
  Description of Artificial Sequence: Synthetic oligonucleotide
  Target: ANGPTL3; (+) strand; PAM type: YTN; PAM sequence: TTT
taaaatttcaattatttaaa

SEQ ID NO: 15521 - DNA, 20 bp, Artificial Sequence
  Description of Artificial Sequence: Synthetic oligonucleotide
  Target: ANGPTL3; (+) strand; PAM type: YTN; PAM sequence: TTT
aaaatttcaattatttaaat

SEQ ID NO: 15522 - DNA, 20 bp, Artificial Sequence
  Description of Artificial Sequence: Synthetic oligonucleotide
  Target: ANGPTL3; (+) strand; PAM type: YTN; PAM sequence: TTA
aaatttcaattatttaaata

SEQ ID NO: 15523 - DNA, 20 bp, Artificial Sequence
  Description of Artificial Sequence: Synthetic oligonucleotide
  Target: ANGPTL3; (+) strand; PAM type: YTN; PAM sequence: TTT
caattatttaaatataatat

SEQ ID NO: 15524 - DNA, 20 bp, Artificial Sequence
  Description of Artificial Sequence: Synthetic oligonucleotide
  Target: ANGPTL3; (+) strand; PAM type: YTN; PAM sequence: TTC
aattatttaaatataatata

SEQ ID NO: 15525 - DNA, 20 bp, Artificial Sequence
  Description of Artificial Sequence: Synthetic oligonucleotide
  Target: ANGPTL3; (+) strand; PAM type: YTN; PAM sequence: TTA
tttaaatataatatatagaa

SEQ ID NO: 15526 - DNA, 20 bp, Artificial Sequence
  Description of Artificial Sequence: Synthetic oligonucleotide
  Target: ANGPTL3; (+) strand; PAM type: YTN; PAM sequence: TTT
aaatataatatatagaatgt

SEQ ID NO: 15527 - DNA, 20 bp, Artificial Sequence
  Description of Artificial Sequence: Synthetic oligonucleotide
  Target: ANGPTL3; (+) strand; PAM type: YTN; PAM sequence: TTA
aatataatatatagaatgta

SEQ ID NO: 15528 - DNA, 20 bp, Artificial Sequence
  Description of Artificial Sequence: Synthetic oligonucleotide
  Target: ANGPTL3; (+) strand; PAM type: YTN; PAM sequence: CTT
ataatgaattagttaactca

SEQ ID NO: 15529 - DNA, 20 bp, Artificial Sequence
  Description of Artificial Sequence: Synthetic oligonucleotide
  Target: ANGPTL3; (+) strand; PAM type: YTN; PAM sequence: TTA
taatgaattagttaactcaa

SEQ ID NO: 15530 - DNA, 20 bp, Artificial Sequence
  Description of Artificial Sequence: Synthetic oligonucleotide
  Target: ANGPTL3; (+) strand; PAM type: YTN; PAM sequence: TTA
gttaactcaatgcaaattat

SEQ ID NO: 15531 - DNA, 20 bp, Artificial Sequence
  Description of Artificial Sequence: Synthetic oligonucleotide
  Target: ANGPTL3; (+) strand; PAM type: YTN; PAM sequence: TTA
actcaatgcaaattattcta

SEQ ID NO: 15532 - DNA, 20 bp, Artificial Sequence
  Description of Artificial Sequence: Synthetic oligonucleotide
  Target: ANGPTL3; (+) strand; PAM type: YTN; PAM sequence: CTC
aatgcaaattattctatttt

SEQ ID NO: 15533 - DNA, 20 bp, Artificial Sequence
  Description of Artificial Sequence: Synthetic oligonucleotide
  Target: ANGPTL3; (+) strand; PAM type: YTN; PAM sequence: TTA
ttctattttgattacaaata

SEQ ID NO: 15534 - DNA, 20 bp, Artificial Sequence
  Description of Artificial Sequence: Synthetic oligonucleotide
  Target: ANGPTL3; (+) strand; PAM type: YTN; PAM sequence: TTC
tattttgattacaaatagta

SEQ ID NO: 15535 - DNA, 20 bp, Artificial Sequence
  Description of Artificial Sequence: Synthetic oligonucleotide
  Target: ANGPTL3; (+) strand; PAM type: YTN; PAM sequence: CTA
ttttgattacaaatagtaaa

SEQ ID NO: 15536 - DNA, 20 bp, Artificial Sequence
  Description of Artificial Sequence: Synthetic oligonucleotide
  Target: ANGPTL3; (+) strand; PAM type: YTN; PAM sequence: TTT
tgattacaaatagtaaaata

SEQ ID NO: 15537 - DNA, 20 bp, Artificial Sequence
  Description of Artificial Sequence: Synthetic oligonucleotide
  Target: ANGPTL3; (+) strand; PAM type: YTN; PAM sequence: TTT
gattacaaatagtaaaataa

SEQ ID NO: 15538 - DNA, 20 bp, Artificial Sequence
  Description of Artificial Sequence: Synthetic oligonucleotide
  Target: ANGPTL3; (+) strand; PAM type: YTN; PAM sequence: TTG
attacaaatagtaaaataag

SEQ ID NO: 15539 - DNA, 20 bp, Artificial Sequence
  Description of Artificial Sequence: Synthetic oligonucleotide
  Target: ANGPTL3; (+) strand; PAM type: YTN; PAM sequence: TTA
caaatagtaaaataagcaag

SEQ ID NO: 15540 - DNA, 20 bp, Artificial Sequence
  Description of Artificial Sequence: Synthetic oligonucleotide
  Target: ANGPTL3; (+) strand; PAM type: YTN; PAM sequence: TTT
aaaatccaaaaagcacatac

SEQ ID NO: 15541 - DNA, 20 bp, Artificial Sequence
  Description of Artificial Sequence: Synthetic oligonucleotide
  Target: ANGPTL3; (+) strand; PAM type: YTN; PAM sequence: TTA
aaatccaaaaagcacataca

SEQ ID NO: 15542 - DNA, 20 bp, Artificial Sequence
  Description of Artificial Sequence: Synthetic oligonucleotide
  Target: ANGPTL3; (+) strand; PAM type: YTN; PAM sequence: CTA
agtactcacttataaagtag

SEQ ID NO: 15543 - DNA, 20 bp, Artificial Sequence
  Description of Artificial Sequence: Synthetic oligonucleotide
  Target: ANGPTL3; (+) strand; PAM type: YTN; PAM sequence: CTC
acttataaagtagaagacat

SEQ ID NO: 15544 - DNA, 20 bp, Artificial Sequence
  Description of Artificial Sequence: Synthetic oligonucleotide
  Target: ANGPTL3; (+) strand; PAM type: YTN; PAM sequence: CTT
ataaagtagaagacattcat

SEQ ID NO: 15545 - DNA, 20 bp, Artificial Sequence
  Description of Artificial Sequence: Synthetic oligonucleotide
  Target: ANGPTL3; (+) strand; PAM type: YTN; PAM sequence: TTA
taaagtagaagacattcatt

SEQ ID NO: 15546 - DNA, 20 bp, Artificial Sequence
  Description of Artificial Sequence: Synthetic oligonucleotide
  Target: ANGPTL3; (+) strand; PAM type: YTN; PAM sequence: TTC
attattatatcaaattttta

SEQ ID NO: 15547 - DNA, 20 bp, Artificial Sequence
  Description of Artificial Sequence: Synthetic oligonucleotide
  Target: ANGPTL3; (+) strand; PAM type: YTN; PAM sequence: TTA
ttatatcaaatttttaaatg

SEQ ID NO: 15548 - DNA, 20 bp, Artificial Sequence
  Description of Artificial Sequence: Synthetic oligonucleotide
  Target: ANGPTL3; (+) strand; PAM type: YTN; PAM sequence: TTA
tatcaaatttttaaatgctc

SEQ ID NO: 15549 - DNA, 20 bp, Artificial Sequence
  Description of Artificial Sequence: Synthetic oligonucleotide
  Target: ANGPTL3; (+) strand; PAM type: YTN; PAM sequence: TTT
ttaaatgctcagtactattt

SEQ ID NO: 15550 - DNA, 20 bp, Artificial Sequence
  Description of Artificial Sequence: Synthetic oligonucleotide
  Target: ANGPTL3; (+) strand; PAM type: YTN; PAM sequence: TTT
taaatgctcagtactatttg

SEQ ID NO: 15551 - DNA, 20 bp, Artificial Sequence
  Description of Artificial Sequence: Synthetic oligonucleotide
  Target: ANGPTL3; (+) strand; PAM type: YTN; PAM sequence: TTT
aaatgctcagtactatttga

SEQ ID NO: 15552 - DNA, 20 bp, Artificial Sequence
  Description of Artificial Sequence: Synthetic oligonucleotide
  Target: ANGPTL3; (+) strand; PAM type: YTN; PAM sequence: TTA
aatgctcagtactatttgac

SEQ ID NO: 15553 - DNA, 20 bp, Artificial Sequence
  Description of Artificial Sequence: Synthetic oligonucleotide
  Target: ANGPTL3; (+) strand; PAM type: YTN; PAM sequence: CTC
agtactatttgaccatttaa

SEQ ID NO: 15554 - DNA, 20 bp, Artificial Sequence
  Description of Artificial Sequence: Synthetic oligonucleotide
  Target: ANGPTL3; (+) strand; PAM type: YTN; PAM sequence: CTA
tttgaccatttaaaaatttt

SEQ ID NO: 15555 - DNA, 20 bp, Artificial Sequence
  Description of Artificial Sequence: Synthetic oligonucleotide
  Target: ANGPTL3; (+) strand; PAM type: YTN; PAM sequence: TTT
gaccatttaaaaattttgta

SEQ ID NO: 15556 - DNA, 20 bp, Artificial Sequence
  Description of Artificial Sequence: Synthetic oligonucleotide
  Target: ANGPTL3; (+) strand; PAM type: YTN; PAM sequence: TTG
accatttaaaaattttgtat

SEQ ID NO: 15557 - DNA, 20 bp, Artificial Sequence
  Description of Artificial Sequence: Synthetic oligonucleotide
  Target: ANGPTL3; (+) strand; PAM type: YTN; PAM sequence: TTT
aaaaattttgtattcaaact

SEQ ID NO: 15558 - DNA, 20 bp, Artificial Sequence
  Description of Artificial Sequence: Synthetic oligonucleotide
  Target: ANGPTL3; (+) strand; PAM type: YTN; PAM sequence: TTA
aaaattttgtattcaaacta

SEQ ID NO: 15559 - DNA, 20 bp, Artificial Sequence
  Description of Artificial Sequence: Synthetic oligonucleotide
  Target: ANGPTL3; (+) strand; PAM type: YTN; PAM sequence: TTT
tgtattcaaactaccagtga

SEQ ID NO: 15560 - DNA, 20 bp, Artificial Sequence
  Description of Artificial Sequence: Synthetic oligonucleotide
  Target: ANGPTL3; (+) strand; PAM type: YTN; PAM sequence: TTT
gtattcaaactaccagtgaa

SEQ ID NO: 15561 - DNA, 20 bp, Artificial Sequence
  Description of Artificial Sequence: Synthetic oligonucleotide
  Target: ANGPTL3; (+) strand; PAM type: YTN; PAM sequence: TTG
tattcaaactaccagtgaaa

SEQ ID NO: 15562 - DNA, 20 bp, Artificial Sequence
  Description of Artificial Sequence: Synthetic oligonucleotide
  Target: ANGPTL3; (+) strand; PAM type: YTN; PAM sequence: TTC
aaactaccagtgaaagccct

SEQ ID NO: 15563 - DNA, 20 bp, Artificial Sequence
  Description of Artificial Sequence: Synthetic oligonucleotide
  Target: ANGPTL3; (+) strand; PAM type: YTN; PAM sequence: CTA
ccagtgaaagccctacctag

SEQ ID NO: 15564 - DNA, 20 bp, Artificial Sequence
  Description of Artificial Sequence: Synthetic oligonucleotide
  Target: ANGPTL3; (+) strand; PAM type: YTN; PAM sequence: CTA
cctagaaggtatactcagtg

SEQ ID NO: 15565 - DNA, 20 bp, Artificial Sequence
  Description of Artificial Sequence: Synthetic oligonucleotide
  Target: ANGPTL3; (+) strand; PAM type: YTN; PAM sequence: CTA
gaaggtatactcagtgataa

SEQ ID NO: 15566 - DNA, 20 bp, Artificial Sequence
  Description of Artificial Sequence: Synthetic oligonucleotide
  Target: ANGPTL3; (+) strand; PAM type: YTN; PAM sequence: CTC
agtgataagttttgtagctc

SEQ ID NO: 15567 - DNA, 20 bp, Artificial Sequence
  Description of Artificial Sequence: Synthetic oligonucleotide
  Target: ANGPTL3; (+) strand; PAM type: YTN; PAM sequence: TTT
tgtagctccaaatcttctaa

SEQ ID NO: 15568 - DNA, 20 bp, Artificial Sequence
  Description of Artificial Sequence: Synthetic oligonucleotide
  Target: ANGPTL3; (+) strand; PAM type: YTN; PAM sequence: TTT
gtagctccaaatcttctaat

SEQ ID NO: 15569 - DNA, 20 bp, Artificial Sequence
  Description of Artificial Sequence: Synthetic oligonucleotide
  Target: ANGPTL3; (+) strand; PAM type: YTN; PAM sequence: TTG
tagctccaaatcttctaata

SEQ ID NO: 15570 - DNA, 20 bp, Artificial Sequence
  Description of Artificial Sequence: Synthetic oligonucleotide
  Target: ANGPTL3; (+) strand; PAM type: YTN; PAM sequence: CTC
caaatcttctaatagtgagt

SEQ ID NO: 15571 - DNA, 20 bp, Artificial Sequence
  Description of Artificial Sequence: Synthetic oligonucleotide
  Target: ANGPTL3; (+) strand; PAM type: YTN; PAM sequence: CTT
ctaatagtgagtgtaacccc

SEQ ID NO: 15572 - DNA, 20 bp, Artificial Sequence
  Description of Artificial Sequence: Synthetic oligonucleotide
  Target: ANGPTL3; (+) strand; PAM type: YTN; PAM sequence: TTC
taatagtgagtgtaacccca

SEQ ID NO: 15573 - DNA, 20 bp, Artificial Sequence
  Description of Artificial Sequence: Synthetic oligonucleotide
  Target: ANGPTL3; (+) strand; PAM type: YTN; PAM sequence: CTA
atagtgagtgtaaccccaaa

SEQ ID NO: 15574 - DNA, 20 bp, Artificial Sequence
  Description of Artificial Sequence: Synthetic oligonucleotide
  Target: ANGPTL3; (+) strand; PAM type: YTN; PAM sequence: CTG
acaggtaagtcgagaatact

SEQ ID NO: 15575 - DNA, 20 bp, Artificial Sequence
  Description of Artificial Sequence: Synthetic oligonucleotide
  Target: ANGPTL3; (+) strand; PAM type: YTN; PAM sequence: CTC
acttaattctggtaagaaag

SEQ ID NO: 15576 - DNA, 20 bp, Artificial Sequence
  Description of Artificial Sequence: Synthetic oligonucleotide
  Target: ANGPTL3; (+) strand; PAM type: YTN; PAM sequence: CTT
aattctggtaagaaagcaac

SEQ ID NO: 15577 - DNA, 20 bp, Artificial Sequence
  Description of Artificial Sequence: Synthetic oligonucleotide
  Target: ANGPTL3; (+) strand; PAM type: YTN; PAM sequence: TTA
attctggtaagaaagcaacc

SEQ ID NO: 15578 - DNA, 20 bp, Artificial Sequence
  Description of Artificial Sequence: Synthetic oligonucleotide
  Target: ANGPTL3; (+) strand; PAM type: YTN; PAM sequence: TTC
tggtaagaaagcaacccatt

SEQ ID NO: 15579 - DNA, 20 bp, Artificial Sequence
  Description of Artificial Sequence: Synthetic oligonucleotide
  Target: ANGPTL3; (+) strand; PAM type: YTN; PAM sequence: CTG
gtaagaaagcaacccatttg

SEQ ID NO: 15580 - DNA, 20 bp, Artificial Sequence
  Description of Artificial Sequence: Synthetic oligonucleotide
  Target: ANGPTL3; (+) strand; PAM type: YTN; PAM sequence: TTT
gtacttgtatttaccagcaa

SEQ ID NO: 15581 - DNA, 20 bp, Artificial Sequence
  Description of Artificial Sequence: Synthetic oligonucleotide
  Target: ANGPTL3; (+) strand; PAM type: YTN; PAM sequence: TTG
tacttgtatttaccagcaat

SEQ ID NO: 15582 - DNA, 20 bp, Artificial Sequence
  Description of Artificial Sequence: Synthetic oligonucleotide
  Target: ANGPTL3; (+) strand; PAM type: YTN; PAM sequence: CTT
gtatttaccagcaatcctta

SEQ ID NO: 15583 - DNA, 20 bp, Artificial Sequence
  Description of Artificial Sequence: Synthetic oligonucleotide
  Target: ANGPTL3; (+) strand; PAM type: YTN; PAM sequence: TTG
tatttaccagcaatccttaa

SEQ ID NO: 15584 - DNA, 20 bp, Artificial Sequence
  Description of Artificial Sequence: Synthetic oligonucleotide
  Target: ANGPTL3; (+) strand; PAM type: YTN; PAM sequence: TTT
accagcaatccttaaaatga

SEQ ID NO: 15585 - DNA, 20 bp, Artificial Sequence
  Description of Artificial Sequence: Synthetic oligonucleotide
  Target: ANGPTL3; (+) strand; PAM type: YTN; PAM sequence: TTA
ccagcaatccttaaaatgaa

SEQ ID NO: 15586 - DNA, 20 bp, Artificial Sequence
  Description of Artificial Sequence: Synthetic oligonucleotide
  Target: ANGPTL3; (+) strand; PAM type: YTN; PAM sequence: CTT
aaaatgaagcttcctactaa

SEQ ID NO: 15587 - DNA, 20 bp, Artificial Sequence
  Description of Artificial Sequence: Synthetic oligonucleotide
  Target: ANGPTL3; (+) strand; PAM type: YTN; PAM sequence: TTA
aaatgaagcttcctactaac

SEQ ID NO: 15588 - DNA, 20 bp, Artificial Sequence
  Description of Artificial Sequence: Synthetic oligonucleotide
  Target: ANGPTL3; (+) strand; PAM type: YTN; PAM sequence: CTT
cctactaactcaatagcaat

SEQ ID NO: 15589 - DNA, 20 bp, Artificial Sequence
  Description of Artificial Sequence: Synthetic oligonucleotide
  Target: ANGPTL3; (+) strand; PAM type: YTN; PAM sequence: TTC
ctactaactcaatagcaata

SEQ ID NO: 15590 - DNA, 20 bp, Artificial Sequence
  Description of Artificial Sequence: Synthetic oligonucleotide
  Target: ANGPTL3; (+) strand; PAM type: YTN; PAM sequence: CTA
ctaactcaatagcaataaga

SEQ ID NO: 15591 - DNA, 20 bp, Artificial Sequence
  Description of Artificial Sequence: Synthetic oligonucleotide
  Target: ANGPTL3; (+) strand; PAM type: YTN; PAM sequence: CTA
actcaatagcaataagacaa

SEQ ID NO: 15592 - DNA, 20 bp, Artificial Sequence
  Description of Artificial Sequence: Synthetic oligonucleotide
  Target: ANGPTL3; (+) strand; PAM type: YTN; PAM sequence: CTC
aatagcaataagacaatagt

SEQ ID NO: 15593 - DNA, 20 bp, Artificial Sequence
  Description of Artificial Sequence: Synthetic oligonucleotide
  Target: ANGPTL3; (+) strand; PAM type: YTN; PAM sequence: TTT
aatgaaaacagtattttata

SEQ ID NO: 15594 - DNA, 20 bp, Artificial Sequence
  Description of Artificial Sequence: Synthetic oligonucleotide
  Target: ANGPTL3; (+) strand; PAM type: YTN; PAM sequence: TTA
atgaaaacagtattttataa

SEQ ID NO: 15595 - DNA, 20 bp, Artificial Sequence
  Description of Artificial Sequence: Synthetic oligonucleotide
  Target: ANGPTL3; (+) strand; PAM type: YTN; PAM sequence: TTT
tataaatactttaataaaaa

SEQ ID NO: 15596 - DNA, 20 bp, Artificial Sequence
  Description of Artificial Sequence: Synthetic oligonucleotide
  Target: ANGPTL3; (+) strand; PAM type: YTN; PAM sequence: TTT
ataaatactttaataaaaag

SEQ ID NO: 15597 - DNA, 20 bp, Artificial Sequence
  Description of Artificial Sequence: Synthetic oligonucleotide
  Target: ANGPTL3; (+) strand; PAM type: YTN; PAM sequence: TTA
taaatactttaataaaaagg

SEQ ID NO: 15598 - DNA, 20 bp, Artificial Sequence
  Description of Artificial Sequence: Synthetic oligonucleotide
  Target: ANGPTL3; (+) strand; PAM type: YTN; PAM sequence: CTT
taataaaaaggattgtgatg

SEQ ID NO: 15599 - DNA, 20 bp, Artificial Sequence
  Description of Artificial Sequence: Synthetic oligonucleotide
  Target: ANGPTL3; (+) strand; PAM type: YTN; PAM sequence: TTT
aataaaaaggattgtgatga

SEQ ID NO: 15600 - DNA, 20 bp, Artificial Sequence
  Description of Artificial Sequence: Synthetic oligonucleotide
  Target: ANGPTL3; (+) strand; PAM type: YTN; PAM sequence: TTA
ataaaaaggattgtgatgaa

SEQ ID NO: 15601 - DNA, 20 bp, Artificial Sequence
  Description of Artificial Sequence: Synthetic oligonucleotide
  Target: ANGPTL3; (+) strand; PAM type: YTN; PAM sequence: TTG
tgatgaagaacaatctattt

SEQ ID NO: 15602 - DNA, 20 bp, Artificial Sequence
  Description of Artificial Sequence: Synthetic oligonucleotide
  Target: ANGPTL3; (+) strand; PAM type: YTN; PAM sequence: CTA
tttatatttgttatttgttt

SEQ ID NO: 15603 - DNA, 20 bp, Artificial Sequence
  Description of Artificial Sequence: Synthetic oligonucleotide
  Target: ANGPTL3; (+) strand; PAM type: YTN; PAM sequence: TTT
atatttgttatttgttttta

SEQ ID NO: 15604 - DNA, 20 bp, Artificial Sequence
  Description of Artificial Sequence: Synthetic oligonucleotide
  Target: ANGPTL3; (+) strand; PAM type: YTN; PAM sequence: TTA
tatttgttatttgtttttaa

SEQ ID NO: 15605 - DNA, 20 bp, Artificial Sequence
  Description of Artificial Sequence: Synthetic oligonucleotide
  Target: ANGPTL3; (+) strand; PAM type: YTN; PAM sequence: TTT
gttatttgtttttaattcca

SEQ ID NO: 15606 - DNA, 20 bp, Artificial Sequence
  Description of Artificial Sequence: Synthetic oligonucleotide
  Target: ANGPTL3; (+) strand; PAM type: YTN; PAM sequence: TTG
ttatttgtttttaattccaa

SEQ ID NO: 15607 - DNA, 20 bp, Artificial Sequence
  Description of Artificial Sequence: Synthetic oligonucleotide
  Target: ANGPTL3; (+) strand; PAM type: YTN; PAM sequence: TTA
tttgtttttaattccaataa

SEQ ID NO: 15608 - DNA, 20 bp, Artificial Sequence
  Description of Artificial Sequence: Synthetic oligonucleotide
  Target: ANGPTL3; (+) strand; PAM type: YTN; PAM sequence: TTT
gtttttaattccaataaaaa

SEQ ID NO: 15609 - DNA, 20 bp, Artificial Sequence
  Description of Artificial Sequence: Synthetic oligonucleotide
  Target: ANGPTL3; (+) strand; PAM type: YTN; PAM sequence: TTG
tttttaattccaataaaaat

SEQ ID NO: 15610 - DNA, 20 bp, Artificial Sequence
  Description of Artificial Sequence: Synthetic oligonucleotide
  Target: ANGPTL3; (+) strand; PAM type: YTN; PAM sequence: TTT
ttaattccaataaaaataat

SEQ ID NO: 15611 - DNA, 20 bp, Artificial Sequence
  Description of Artificial Sequence: Synthetic oligonucleotide
  Target: ANGPTL3; (+) strand; PAM type: YTN; PAM sequence: TTT
taattccaataaaaataatt

SEQ ID NO: 15612 - DNA, 20 bp, Artificial Sequence
  Description of Artificial Sequence: Synthetic oligonucleotide
  Target: ANGPTL3; (+) strand; PAM type: YTN; PAM sequence: TTT
aattccaataaaaataattt

SEQ ID NO: 15613 - DNA, 20 bp, Artificial Sequence
  Description of Artificial Sequence: Synthetic oligonucleotide
  Target: ANGPTL3; (+) strand; PAM type: YTN; PAM sequence: TTA
attccaataaaaataatttt

SEQ ID NO: 15614 - DNA, 20 bp, Artificial Sequence
  Description of Artificial Sequence: Synthetic oligonucleotide
  Target: ANGPTL3; (+) strand; PAM type: YTN; PAM sequence: TTC
caataaaaataatttttaaa

SEQ ID NO: 15615 - DNA, 20 bp, Artificial Sequence
  Description of Artificial Sequence: Synthetic oligonucleotide
  Target: ANGPTL3; (+) strand; PAM type: YTN; PAM sequence: TTT
ttaaaattacagaaaaaagt

SEQ ID NO: 15616 - DNA, 20 bp, Artificial Sequence
  Description of Artificial Sequence: Synthetic oligonucleotide
  Target: ANGPTL3; (+) strand; PAM type: YTN; PAM sequence: TTT
taaaattacagaaaaaagtt

SEQ ID NO: 15617 - DNA, 20 bp, Artificial Sequence
  Description of Artificial Sequence: Synthetic oligonucleotide
  Target: ANGPTL3; (+) strand; PAM type: YTN; PAM sequence: TTT
aaaattacagaaaaaagtta

SEQ ID NO: 15618 - DNA, 20 bp, Artificial Sequence
  Description of Artificial Sequence: Synthetic oligonucleotide
  Target: ANGPTL3; (+) strand; PAM type: YTN; PAM sequence: TTA
aaattacagaaaaaagttat

SEQ ID NO: 15619 - DNA, 20 bp, Artificial Sequence
  Description of Artificial Sequence: Synthetic oligonucleotide
  Target: ANGPTL3; (+) strand; PAM type: YTN; PAM sequence: TTA
cagaaaaaagttattaagaa

SEQ ID NO: 15620 - DNA, 20 bp, Artificial Sequence
  Description of Artificial Sequence: Synthetic oligonucleotide
  Target: ANGPTL3; (+) strand; PAM type: YTN; PAM sequence: TTA
ttaagaaccatgcttttaaa

SEQ ID NO: 15621 - DNA, 20 bp, Artificial Sequence
  Description of Artificial Sequence: Synthetic oligonucleotide
  Target: ANGPTL3; (+) strand; PAM type: YTN; PAM sequence: TTA
agaaccatgcttttaaattt

SEQ ID NO: 15622 - DNA, 20 bp, Artificial Sequence
  Description of Artificial Sequence: Synthetic oligonucleotide
  Target: ANGPTL3; (+) strand; PAM type: YTN; PAM sequence: CTT
ttaaatttaaaatgattttt

SEQ ID NO: 15623 - DNA, 20 bp, Artificial Sequence
  Description of Artificial Sequence: Synthetic oligonucleotide
  Target: ANGPTL3; (+) strand; PAM type: YTN; PAM sequence: TTT
taaatttaaaatgatttttt

SEQ ID NO: 15624 - DNA, 20 bp, Artificial Sequence
  Description of Artificial Sequence: Synthetic oligonucleotide
  Target: ANGPTL3; (+) strand; PAM type: YTN; PAM sequence: TTT
aaatttaaaatgatttttta

SEQ ID NO: 15625 - DNA, 20 bp, Artificial Sequence
  Description of Artificial Sequence: Synthetic oligonucleotide
  Target: ANGPTL3; (+) strand; PAM type: YTN; PAM sequence: TTA
aatttaaaatgattttttaa

SEQ ID NO: 15626 - DNA, 20 bp, Artificial Sequence
  Description of Artificial Sequence: Synthetic oligonucleotide
  Target: ANGPTL3; (+) strand; PAM type: YTN; PAM sequence: TTT
aaaatgattttttaaattta

SEQ ID NO: 15627 - DNA, 20 bp, Artificial Sequence
  Description of Artificial Sequence: Synthetic oligonucleotide
  Target: ANGPTL3; (+) strand; PAM type: YTN; PAM sequence: TTA
aaatgattttttaaatttat

SEQ ID NO: 15628 - DNA, 20 bp, Artificial Sequence
  Description of Artificial Sequence: Synthetic oligonucleotide
  Target: ANGPTL3; (+) strand; PAM type: YTN; PAM sequence: TTT
tttaaatttattcctgtctt

SEQ ID NO: 15629 - DNA, 20 bp, Artificial Sequence
  Description of Artificial Sequence: Synthetic oligonucleotide
  Target: ANGPTL3; (+) strand; PAM type: YTN; PAM sequence: TTT
ttaaatttattcctgtcttt

SEQ ID NO: 15630 - DNA, 20 bp, Artificial Sequence
  Description of Artificial Sequence: Synthetic oligonucleotide
  Target: ANGPTL3; (+) strand; PAM type: YTN; PAM sequence: TTT
taaatttattcctgtctttt

SEQ ID NO: 15631 - DNA, 20 bp, Artificial Sequence
  Description of Artificial Sequence: Synthetic oligonucleotide
  Target: ANGPTL3; (+) strand; PAM type: YTN; PAM sequence: TTT
aaatttattcctgtcttttt

SEQ ID NO: 15632 - DNA, 20 bp, Artificial Sequence
  Description of Artificial Sequence: Synthetic oligonucleotide
  Target: ANGPTL3; (+) strand; PAM type: YTN; PAM sequence: TTA
aatttattcctgtctttttc

SEQ ID NO: 15633 - DNA, 20 bp, Artificial Sequence
  Description of Artificial Sequence: Synthetic oligonucleotide
  Target: ANGPTL3; (+) strand; PAM type: YTN; PAM sequence: TTT
attcctgtctttttctacaa

SEQ ID NO: 15634 - DNA, 20 bp, Artificial Sequence
  Description of Artificial Sequence: Synthetic oligonucleotide
  Target: ANGPTL3; (+) strand; PAM type: YTN; PAM sequence: TTA
ttcctgtctttttctacaaa

SEQ ID NO: 15635 - DNA, 20 bp, Artificial Sequence
  Description of Artificial Sequence: Synthetic oligonucleotide
  Target: ANGPTL3; (+) strand; PAM type: YTN; PAM sequence: TTC
ctgtctttttctacaaagaa

SEQ ID NO: 15636 - DNA, 20 bp, Artificial Sequence
  Description of Artificial Sequence: Synthetic oligonucleotide
  Target: ANGPTL3; (+) strand; PAM type: YTN; PAM sequence: CTG
tctttttctacaaagaaagc

SEQ ID NO: 15637 - DNA, 20 bp, Artificial Sequence
  Description of Artificial Sequence: Synthetic oligonucleotide
  Target: ANGPTL3; (+) strand; PAM type: YTN; PAM sequence: CTT
tttctacaaagaaagcatac

SEQ ID NO: 15638 - DNA, 20 bp, Artificial Sequence
  Description of Artificial Sequence: Synthetic oligonucleotide
  Target: ANGPTL3; (+) strand; PAM type: YTN; PAM sequence: TTT
ttctacaaagaaagcataca

SEQ ID NO: 15639 - DNA, 20 bp, Artificial Sequence
  Description of Artificial Sequence: Synthetic oligonucleotide
  Target: ANGPTL3; (+) strand; PAM type: YTN; PAM sequence: TTT
tctacaaagaaagcatacat

SEQ ID NO: 15640 - DNA, 20 bp, Artificial Sequence
  Description of Artificial Sequence: Synthetic oligonucleotide
  Target: ANGPTL3; (+) strand; PAM type: YTN; PAM sequence: TTT
ctacaaagaaagcatacatt

SEQ ID NO: 15641 - DNA, 20 bp, Artificial Sequence
  Description of Artificial Sequence: Synthetic oligonucleotide
  Target: ANGPTL3; (+) strand; PAM type: YTN; PAM sequence: TTC
tacaaagaaagcatacatta

SEQ ID NO: 15642 - DNA, 20 bp, Artificial Sequence
  Description of Artificial Sequence: Synthetic oligonucleotide
  Target: ANGPTL3; (+) strand; PAM type: YTN; PAM sequence: CTA
caaagaaagcatacattaag

SEQ ID NO: 15643 - DNA, 20 bp, Artificial Sequence
  Description of Artificial Sequence: Synthetic oligonucleotide
  Target: ANGPTL3; (+) strand; PAM type: YTN; PAM sequence: TTA
agcaaataccaaaggccagg

SEQ ID NO: 15644 - DNA, 20 bp, Artificial Sequence
  Description of Artificial Sequence: Synthetic oligonucleotide
  Target: ANGPTL3; (+) strand; PAM type: YTN; PAM sequence: TTT
acatttgaagaaagtgacat

SEQ ID NO: 15645 - DNA, 20 bp, Artificial Sequence
  Description of Artificial Sequence: Synthetic oligonucleotide
  Target: ANGPTL3; (+) strand; PAM type: YTN; PAM sequence: TTA
catttgaagaaagtgacatt

SEQ ID NO: 15646 - DNA, 20 bp, Artificial Sequence
  Description of Artificial Sequence: Synthetic oligonucleotide
  Target: ANGPTL3; (+) strand; PAM type: YTN; PAM sequence: TTT
gaagaaagtgacattattat

SEQ ID NO: 15647 - DNA, 20 bp, Artificial Sequence
  Description of Artificial Sequence: Synthetic oligonucleotide
  Target: ANGPTL3; (+) strand; PAM type: YTN; PAM sequence: TTG
aagaaagtgacattattatt

SEQ ID NO: 15648 - DNA, 20 bp, Artificial Sequence
  Description of Artificial Sequence: Synthetic oligonucleotide
  Target: ANGPTL3; (+) strand; PAM type: YTN; PAM sequence: TTA
ttattactcaagtctctagg

SEQ ID NO: 15649 - DNA, 20 bp, Artificial Sequence
  Description of Artificial Sequence: Synthetic oligonucleotide
  Target: ANGPTL3; (+) strand; PAM type: YTN; PAM sequence: TTA
ttactcaagtctctaggaat

SEQ ID NO: 15650 - DNA, 20 bp, Artificial Sequence
  Description of Artificial Sequence: Synthetic oligonucleotide
  Target: ANGPTL3; (+) strand; PAM type: YTN; PAM sequence: TTA
ctcaagtctctaggaatact

SEQ ID NO: 15651 - DNA, 20 bp, Artificial Sequence
  Description of Artificial Sequence: Synthetic oligonucleotide
  Target: ANGPTL3; (+) strand; PAM type: YTN; PAM sequence: CTC
aagtctctaggaatacttaa

SEQ ID NO: 15652 - DNA, 20 bp, Artificial Sequence
  Description of Artificial Sequence: Synthetic oligonucleotide
  Target: ANGPTL3; (+) strand; PAM type: YTN; PAM sequence: CTC
taggaatacttaacacatct

SEQ ID NO: 15653 - DNA, 20 bp, Artificial Sequence
  Description of Artificial Sequence: Synthetic oligonucleotide
  Target: ANGPTL3; (+) strand; PAM type: YTN; PAM sequence: CTA
ggaatacttaacacatctct

SEQ ID NO: 15654 - DNA, 20 bp, Artificial Sequence
  Description of Artificial Sequence: Synthetic oligonucleotide
  Target: ANGPTL3; (+) strand; PAM type: YTN; PAM sequence: CTT
aacacatctcttgactgtat

SEQ ID NO: 15655 - DNA, 20 bp, Artificial Sequence
  Description of Artificial Sequence: Synthetic oligonucleotide
  Target: ANGPTL3; (+) strand; PAM type: YTN; PAM sequence: TTA
acacatctcttgactgtata

SEQ ID NO: 15656 - DNA, 20 bp, Artificial Sequence
  Description of Artificial Sequence: Synthetic oligonucleotide
  Target: ANGPTL3; (+) strand; PAM type: YTN; PAM sequence: CTC
ttgactgtatatggatgtta

SEQ ID NO: 15657 - DNA, 20 bp, Artificial Sequence
  Description of Artificial Sequence: Synthetic oligonucleotide
  Target: ANGPTL3; (+) strand; PAM type: YTN; PAM sequence: CTT
gactgtatatggatgttaat

SEQ ID NO: 15658 - DNA, 20 bp, Artificial Sequence
  Description of Artificial Sequence: Synthetic oligonucleotide
  Target: ANGPTL3; (+) strand; PAM type: YTN; PAM sequence: TTG
actgtatatggatgttaata

SEQ ID NO: 15659 - DNA, 20 bp, Artificial Sequence
  Description of Artificial Sequence: Synthetic oligonucleotide
  Target: ANGPTL3; (+) strand; PAM type: YTN; PAM sequence: CTG
tatatggatgttaataaata

SEQ ID NO: 15660 - DNA, 20 bp, Artificial Sequence
  Description of Artificial Sequence: Synthetic oligonucleotide
  Target: ANGPTL3; (+) strand; PAM type: YTN; PAM sequence: TTA
ataaatagctgacagtaaag

SEQ ID NO: 15661 - DNA, 20 bp, Artificial Sequence
  Description of Artificial Sequence: Synthetic oligonucleotide
  Target: ANGPTL3; (+) strand; PAM type: YTN; PAM sequence: CTG
acagtaaagtttatccatat

SEQ ID NO: 15662 - DNA, 20 bp, Artificial Sequence
  Description of Artificial Sequence: Synthetic oligonucleotide
  Target: ANGPTL3; (+) strand; PAM type: YTN; PAM sequence: TTT
atccatataaagacttgcaa

SEQ ID NO: 15663 - DNA, 20 bp, Artificial Sequence
  Description of Artificial Sequence: Synthetic oligonucleotide
  Target: ANGPTL3; (+) strand; PAM type: YTN; PAM sequence: TTA
tccatataaagacttgcaaa

SEQ ID NO: 15664 - DNA, 20 bp, Artificial Sequence
  Description of Artificial Sequence: Synthetic oligonucleotide
  Target: ANGPTL3; (+) strand; PAM type: YTN; PAM sequence: CTT
gcaaatattcctctaccaat

SEQ ID NO: 15665 - DNA, 20 bp, Artificial Sequence
  Description of Artificial Sequence: Synthetic oligonucleotide
  Target: ANGPTL3; (+) strand; PAM type: YTN; PAM sequence: TTG
caaatattcctctaccaatg

SEQ ID NO: 15666 - DNA, 20 bp, Artificial Sequence
  Description of Artificial Sequence: Synthetic oligonucleotide
  Target: ANGPTL3; (+) strand; PAM type: YTN; PAM sequence: TTC
ctctaccaatgacgagactt

SEQ ID NO: 15667 - DNA, 20 bp, Artificial Sequence
  Description of Artificial Sequence: Synthetic oligonucleotide
  Target: ANGPTL3; (+) strand; PAM type: YTN; PAM sequence: CTC
taccaatgacgagactttaa

SEQ ID NO: 15668 - DNA, 20 bp, Artificial Sequence
  Description of Artificial Sequence: Synthetic oligonucleotide
  Target: ANGPTL3; (+) strand; PAM type: YTN; PAM sequence: CTA
ccaatgacgagactttaaaa

SEQ ID NO: 15669 - DNA, 20 bp, Artificial Sequence
  Description of Artificial Sequence: Synthetic oligonucleotide
  Target: ANGPTL3; (+) strand; PAM type: YTN; PAM sequence: CTT
taaaatatctataataatgt

SEQ ID NO: 15670 - DNA, 20 bp, Artificial Sequence
  Description of Artificial Sequence: Synthetic oligonucleotide
  Target: ANGPTL3; (+) strand; PAM type: YTN; PAM sequence: TTT
aaaatatctataataatgta

SEQ ID NO: 15671 - DNA, 20 bp, Artificial Sequence
  Description of Artificial Sequence: Synthetic oligonucleotide
  Target: ANGPTL3; (+) strand; PAM type: YTN; PAM sequence: TTA
aaatatctataataatgtaa

SEQ ID NO: 15672 - DNA, 20 bp, Artificial Sequence
  Description of Artificial Sequence: Synthetic oligonucleotide
  Target: ANGPTL3; (+) strand; PAM type: YTN; PAM sequence: CTA
taataatgtaacacatttca

SEQ ID NO: 15673 - DNA, 20 bp, Artificial Sequence
  Description of Artificial Sequence: Synthetic oligonucleotide
  Target: ANGPTL3; (+) strand; PAM type: YTN; PAM sequence: TTT
cactggtgaaacatgtcttg

SEQ ID NO: 15674 - DNA, 20 bp, Artificial Sequence
  Description of Artificial Sequence: Synthetic oligonucleotide
  Target: ANGPTL3; (+) strand; PAM type: YTN; PAM sequence: TTC
actggtgaaacatgtcttgt

SEQ ID NO: 15675 - DNA, 20 bp, Artificial Sequence
  Description of Artificial Sequence: Synthetic oligonucleotide
  Target: ANGPTL3; (+) strand; PAM type: YTN; PAM sequence: CTG
gtgaaacatgtcttgtcata

SEQ ID NO: 15676 - DNA, 20 bp, Artificial Sequence
  Description of Artificial Sequence: Synthetic oligonucleotide
  Target: ANGPTL3; (+) strand; PAM type: YTN; PAM sequence: CTT
gtcatatgcattatagaaag

SEQ ID NO: 15677 - DNA, 20 bp, Artificial Sequence
  Description of Artificial Sequence: Synthetic oligonucleotide
  Target: ANGPTL3; (+) strand; PAM type: YTN; PAM sequence: TTG
tcatatgcattatagaaagg

SEQ ID NO: 15678 - DNA, 20 bp, Artificial Sequence
  Description of Artificial Sequence: Synthetic oligonucleotide
  Target: ANGPTL3; (+) strand; PAM type: YTN; PAM sequence: TTA
tagaaaggataatcagactt

SEQ ID NO: 15679 - DNA, 20 bp, Artificial Sequence
  Description of Artificial Sequence: Synthetic oligonucleotide
  Target: ANGPTL3; (+) strand; PAM type: YTN; PAM sequence: CTT
tcagttatattaatattttt

SEQ ID NO: 15680 - DNA, 20 bp, Artificial Sequence
  Description of Artificial Sequence: Synthetic oligonucleotide
  Target: ANGPTL3; (+) strand; PAM type: YTN; PAM sequence: TTT
cagttatattaatattttta

SEQ ID NO: 15681 - DNA, 20 bp, Artificial Sequence
  Description of Artificial Sequence: Synthetic oligonucleotide
  Target: ANGPTL3; (+) strand; PAM type: YTN; PAM sequence: TTC
agttatattaatatttttaa

SEQ ID NO: 15682 - DNA, 20 bp, Artificial Sequence
  Description of Artificial Sequence: Synthetic oligonucleotide
  Target: ANGPTL3; (+) strand; PAM type: YTN; PAM sequence: TTA
tattaatatttttaacattt

SEQ ID NO: 15683 - DNA, 20 bp, Artificial Sequence
  Description of Artificial Sequence: Synthetic oligonucleotide
  Target: ANGPTL3; (+) strand; PAM type: YTN; PAM sequence: TTA
atatttttaacatttttgtg

SEQ ID NO: 15684 - DNA, 20 bp, Artificial Sequence
  Description of Artificial Sequence: Synthetic oligonucleotide
  Target: ANGPTL3; (+) strand; PAM type: YTN; PAM sequence: TTT
ttaacatttttgtgcacata

SEQ ID NO: 15685 - DNA, 20 bp, Artificial Sequence
  Description of Artificial Sequence: Synthetic oligonucleotide
  Target: ANGPTL3; (+) strand; PAM type: YTN; PAM sequence: TTT
taacatttttgtgcacatag

SEQ ID NO: 15686 - DNA, 20 bp, Artificial Sequence
  Description of Artificial Sequence: Synthetic oligonucleotide
  Target: ANGPTL3; (+) strand; PAM type: YTN; PAM sequence: TTT
aacatttttgtgcacatagc

SEQ ID NO: 15687 - DNA, 20 bp, Artificial Sequence
  Description of Artificial Sequence: Synthetic oligonucleotide
  Target: ANGPTL3; (+) strand; PAM type: YTN; PAM sequence: TTA
acatttttgtgcacatagct

SEQ ID NO: 15688 - DNA, 20 bp, Artificial Sequence
  Description of Artificial Sequence: Synthetic oligonucleotide
  Target: ANGPTL3; (+) strand; PAM type: YTN; PAM sequence: TTT
ttgtgcacatagctatcttc

SEQ ID NO: 15689 - DNA, 20 bp, Artificial Sequence
  Description of Artificial Sequence: Synthetic oligonucleotide
  Target: ANGPTL3; (+) strand; PAM type: YTN; PAM sequence: TTT
tgtgcacatagctatcttca

SEQ ID NO: 15690 - DNA, 20 bp, Artificial Sequence
  Description of Artificial Sequence: Synthetic oligonucleotide
  Target: ANGPTL3; (+) strand; PAM type: YTN; PAM sequence: TTT
gtgcacatagctatcttcaa

SEQ ID NO: 15691 - DNA, 20 bp, Artificial Sequence
  Description of Artificial Sequence: Synthetic oligonucleotide
  Target: ANGPTL3; (+) strand; PAM type: YTN; PAM sequence: TTG
tgcacatagctatcttcaat

SEQ ID NO: 15692 - DNA, 20 bp, Artificial Sequence
  Description of Artificial Sequence: Synthetic oligonucleotide
  Target: ANGPTL3; (+) strand; PAM type: YTN; PAM sequence: CTA
tcttcaataaaattgtttta

SEQ ID NO: 15693 - DNA, 20 bp, Artificial Sequence
  Description of Artificial Sequence: Synthetic oligonucleotide
  Target: ANGPTL3; (+) strand; PAM type: YTN; PAM sequence: CTT
caataaaattgttttaaaag

SEQ ID NO: 15694 - DNA, 20 bp, Artificial Sequence
  Description of Artificial Sequence: Synthetic oligonucleotide
  Target: ANGPTL3; (+) strand; PAM type: YTN; PAM sequence: TTC
aataaaattgttttaaaagg

SEQ ID NO: 15695 - DNA, 20 bp, Artificial Sequence
  Description of Artificial Sequence: Synthetic oligonucleotide
  Target: ANGPTL3; (+) strand; PAM type: YTN; PAM sequence: TTG
ttttaaaaggtattatttta

SEQ ID NO: 15696 - DNA, 20 bp, Artificial Sequence
  Description of Artificial Sequence: Synthetic oligonucleotide
  Target: ANGPTL3; (+) strand; PAM type: YTN; PAM sequence: TTT
taaaaggtattattttaaga

SEQ ID NO: 15697 - DNA, 20 bp, Artificial Sequence
  Description of Artificial Sequence: Synthetic oligonucleotide
  Target: ANGPTL3; (+) strand; PAM type: YTN; PAM sequence: TTT
aaaaggtattattttaagat

SEQ ID NO: 15698 - DNA, 20 bp, Artificial Sequence
  Description of Artificial Sequence: Synthetic oligonucleotide
  Target: ANGPTL3; (+) strand; PAM type: YTN; PAM sequence: TTA
aaaggtattattttaagata

SEQ ID NO: 15699 - DNA, 20 bp, Artificial Sequence
  Description of Artificial Sequence: Synthetic oligonucleotide
  Target: ANGPTL3; (+) strand; PAM type: YTN; PAM sequence: TTA
ttttaagatacactaaaatg

SEQ ID NO: 15700 - DNA, 20 bp, Artificial Sequence
  Description of Artificial Sequence: Synthetic oligonucleotide
  Target: ANGPTL3; (+) strand; PAM type: YTN; PAM sequence: TTT
taagatacactaaaatgatc

SEQ ID NO: 15701 - DNA, 20 bp, Artificial Sequence
  Description of Artificial Sequence: Synthetic oligonucleotide
  Target: ANGPTL3; (+) strand; PAM type: YTN; PAM sequence: TTT
aagatacactaaaatgatca

SEQ ID NO: 15702 - DNA, 20 bp, Artificial Sequence
  Description of Artificial Sequence: Synthetic oligonucleotide
  Target: ANGPTL3; (+) strand; PAM type: YTN; PAM sequence: TTA
agatacactaaaatgatcaa

SEQ ID NO: 15703 - DNA, 20 bp, Artificial Sequence
  Description of Artificial Sequence: Synthetic oligonucleotide
  Target: ANGPTL3; (+) strand; PAM type: YTN; PAM sequence: CTA
aaatgatcaagggattcaag

SEQ ID NO: 15704 - DNA, 20 bp, Artificial Sequence
  Description of Artificial Sequence: Synthetic oligonucleotide
  Target: ANGPTL3; (+) strand; PAM type: YTN; PAM sequence: TTC
aagactaaacaactcaatta

SEQ ID NO: 15705 - DNA, 20 bp, Artificial Sequence
  Description of Artificial Sequence: Synthetic oligonucleotide
  Target: ANGPTL3; (+) strand; PAM type: YTN; PAM sequence: CTA
aacaactcaattagttgcac

SEQ ID NO: 15706 - DNA, 20 bp, Artificial Sequence
  Description of Artificial Sequence: Synthetic oligonucleotide
  Target: ANGPTL3; (+) strand; PAM type: YTN; PAM sequence: CTC
aattagttgcaccaataaaa

SEQ ID NO: 15707 - DNA, 20 bp, Artificial Sequence
  Description of Artificial Sequence: Synthetic oligonucleotide
  Target: ANGPTL3; (+) strand; PAM type: YTN; PAM sequence: TTA
gttgcaccaataaaaaacac

SEQ ID NO: 15708 - DNA, 20 bp, Artificial Sequence
  Description of Artificial Sequence: Synthetic oligonucleotide
  Target: ANGPTL3; (+) strand; PAM type: YTN; PAM sequence: TTG
caccaataaaaaacacttaa

SEQ ID NO: 15709 - DNA, 20 bp, Artificial Sequence
  Description of Artificial Sequence: Synthetic oligonucleotide
  Target: ANGPTL3; (+) strand; PAM type: YTN; PAM sequence: CTT
aaaaaaactgtcagtgtcca

SEQ ID NO: 15710 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaactgtcagtgtccaa

SEQ ID NO: 15711 - DNA, 20 bp, Artificial Sequence
  Description of Artificial Sequence: Synthetic oligonucleotide
  Target: ANGPTL3; (+) strand; PAM type: YTN; PAM sequence: CTG
tcagtgtccaacctgtactt

SEQ ID NO: 15712 - DNA, 20 bp, Artificial Sequence
  Description of Artificial Sequence: Synthetic oligonucleotide
  Target: ANGPTL3; (+) strand; PAM type: YTN; PAM sequence: CTG
tacttaataactcacagatt

SEQ ID NO: 15713 - DNA, 20 bp, Artificial Sequence
  Description of Artificial Sequence: Synthetic oligonucleotide
  Target: ANGPTL3; (+) strand; PAM type: YTN; PAM sequence: CTT
aataactcacagatttttaa

SEQ ID NO: 15714 - DNA, 20 bp, Artificial Sequence
  Description of Artificial Sequence: Synthetic oligonucleotide
  Target: ANGPTL3; (+) strand; PAM type: YTN; PAM sequence: TTA
ataactcacagatttttaaa

SEQ ID NO: 15715 - DNA, 20 bp, Artificial Sequence
  Description of Artificial Sequence: Synthetic oligonucleotide
  Target: ANGPTL3; (+) strand; PAM type: YTN; PAM sequence: CTC
acagatttttaaaacttttc

SEQ ID NO: 15716 - DNA, 20 bp, Artificial Sequence
  Description of Artificial Sequence: Synthetic oligonucleotide
  Target: ANGPTL3; (+) strand; PAM type: YTN; PAM sequence: TTT
ttaaaacttttcttttcagg

SEQ ID NO: 15717 - DNA, 20 bp, Artificial Sequence
  Description of Artificial Sequence: Synthetic oligonucleotide
  Target: ANGPTL3; (+) strand; PAM type: YTN; PAM sequence: TTT
taaaacttttcttttcagga

SEQ ID NO: 15718 - DNA, 20 bp, Artificial Sequence
  Description of Artificial Sequence: Synthetic oligonucleotide
  Target: ANGPTL3; (+) strand; PAM type: YTN; PAM sequence: TTT
aaaacttttcttttcaggag

SEQ ID NO: 15719 - DNA, 20 bp, Artificial Sequence
  Description of Artificial Sequence: Synthetic oligonucleotide
  Target: ANGPTL3; (+) strand; PAM type: YTN; PAM sequence: TTA
aaacttttcttttcaggaga

SEQ ID NO: 15720 - DNA, 20 bp, Artificial Sequence
  Description of Artificial Sequence: Synthetic oligonucleotide
  Target: ANGPTL3; (+) strand; PAM type: YTN; PAM sequence: CTT
ttcttttcaggagaattttg

SEQ ID NO: 15721 - DNA, 20 bp, Artificial Sequence
  Description of Artificial Sequence: Synthetic oligonucleotide
  Target: ANGPTL3; (+) strand; PAM type: YTN; PAM sequence: TTT
tcttttcaggagaattttgg

SEQ ID NO: 15722 - DNA, 20 bp, Artificial Sequence
  Description of Artificial Sequence: Synthetic oligonucleotide
  Target: ANGPTL3; (+) strand; PAM type: YTN; PAM sequence: TTT
cttttcaggagaattttggt

SEQ ID NO: 15723 - DNA, 20 bp, Artificial Sequence
  Description of Artificial Sequence: Synthetic oligonucleotide
  Target: ANGPTL3; (+) strand; PAM type: YTN; PAM sequence: TTC
ttttcaggagaattttggtt

SEQ ID NO: 15724 - DNA, 20 bp, Artificial Sequence
  Description of Artificial Sequence: Synthetic oligonucleotide
  Target: ANGPTL3; (+) strand; PAM type: YTN; PAM sequence: CTT
ttcaggagaattttggttgg

SEQ ID NO: 15725 - DNA, 20 bp, Artificial Sequence
  Description of Artificial Sequence: Synthetic oligonucleotide
  Target: ANGPTL3; (+) strand; PAM type: YTN; PAM sequence: TTT
tcaggagaattttggttggg

SEQ ID NO: 15726 - DNA, 20 bp, Artificial Sequence
  Description of Artificial Sequence: Synthetic oligonucleotide
  Target: ANGPTL3; (+) strand; PAM type: YTN; PAM sequence: TTT
caggagaattttggttgggc

SEQ ID NO: 15727 - DNA, 20 bp, Artificial Sequence
  Description of Artificial Sequence: Synthetic oligonucleotide
  Target: ANGPTL3; (+) strand; PAM type: YTN; PAM sequence: TTC
aggagaattttggttgggcc

SEQ ID NO: 15728 - DNA, 20 bp, Artificial Sequence
  Description of Artificial Sequence: Synthetic oligonucleotide
  Target: ANGPTL3; (+) strand; PAM type: YTN; PAM sequence: TTT
tggttgggcctagagaagat

SEQ ID NO: 15729 - DNA, 20 bp, Artificial Sequence
  Description of Artificial Sequence: Synthetic oligonucleotide
  Target: ANGPTL3; (+) strand; PAM type: YTN; PAM sequence: TTT
ggttgggcctagagaagata

SEQ ID NO: 15730 - DNA, 20 bp, Artificial Sequence
  Description of Artificial Sequence: Synthetic oligonucleotide
  Target: ANGPTL3; (+) strand; PAM type: YTN; PAM sequence: TTG
gttgggcctagagaagatat

SEQ ID NO: 15731 - DNA, 20 bp, Artificial Sequence
  Description of Artificial Sequence: Synthetic oligonucleotide
  Target: ANGPTL3; (+) strand; PAM type: YTN; PAM sequence: TTG
ggcctagagaagatatactc

SEQ ID NO: 15732 - DNA, 20 bp, Artificial Sequence
  Description of Artificial Sequence: Synthetic oligonucleotide
  Target: ANGPTL3; (+) strand; PAM type: YTN; PAM sequence: CTA
gagaagatatactccatagt

SEQ ID NO: 15733 - DNA, 20 bp, Artificial Sequence
  Description of Artificial Sequence: Synthetic oligonucleotide
  Target: ANGPTL3; (+) strand; PAM type: YTN; PAM sequence: CTC
catagtgaagcaatctaatt

SEQ ID NO: 15734 - DNA, 20 bp, Artificial Sequence
  Description of Artificial Sequence: Synthetic oligonucleotide
  Target: ANGPTL3; (+) strand; PAM type: YTN; PAM sequence: CTA
attatgttttacgaattgag

SEQ ID NO: 15735 - DNA, 20 bp, Artificial Sequence
  Description of Artificial Sequence: Synthetic oligonucleotide
  Target: ANGPTL3; (+) strand; PAM type: YTN; PAM sequence: TTA
tgttttacgaattgagttgg

SEQ ID NO: 15736 - DNA, 20 bp, Artificial Sequence
  Description of Artificial Sequence: Synthetic oligonucleotide
  Target: ANGPTL3; (+) strand; PAM type: YTN; PAM sequence: TTT
tacgaattgagttggaagac

SEQ ID NO: 15737 - DNA, 20 bp, Artificial Sequence
  Description of Artificial Sequence: Synthetic oligonucleotide
  Target: ANGPTL3; (+) strand; PAM type: YTN; PAM sequence: TTT
acgaattgagttggaagact

SEQ ID NO: 15738 - DNA, 20 bp, Artificial Sequence
  Description of Artificial Sequence: Synthetic oligonucleotide
  Target: ANGPTL3; (+) strand; PAM type: YTN; PAM sequence: TTA
cgaattgagttggaagactg

SEQ ID NO: 15739 - DNA, 20 bp, Artificial Sequence
  Description of Artificial Sequence: Synthetic oligonucleotide
  Target: ANGPTL3; (+) strand; PAM type: YTN; PAM sequence: TTG
agttggaagactggaaagac

SEQ ID NO: 15740 - DNA, 20 bp, Artificial Sequence
  Description of Artificial Sequence: Synthetic oligonucleotide
  Target: ANGPTL3; (+) strand; PAM type: YTN; PAM sequence: TTG
gaagactggaaagacaacaa

SEQ ID NO: 15741 - DNA, 20 bp, Artificial Sequence
  Description of Artificial Sequence: Synthetic oligonucleotide
  Target: ANGPTL3; (+) strand; PAM type: YTN; PAM sequence: CTG
gaaagacaacaaacattata

SEQ ID NO: 15742 - DNA, 20 bp, Artificial Sequence
  Description of Artificial Sequence: Synthetic oligonucleotide
  Target: ANGPTL3; (+) strand; PAM type: YTN; PAM sequence: TTA
tattgaatattctttttact

SEQ ID NO: 15743 - DNA, 20 bp, Artificial Sequence
  Description of Artificial Sequence: Synthetic oligonucleotide
  Target: ANGPTL3; (+) strand; PAM type: YTN; PAM sequence: TTG
aatattctttttacttggga

SEQ ID NO: 15744 - DNA, 20 bp, Artificial Sequence
  Description of Artificial Sequence: Synthetic oligonucleotide
  Target: ANGPTL3; (+) strand; PAM type: YTN; PAM sequence: TTC
tttttacttgggaaatcacg

SEQ ID NO: 15745 - DNA, 20 bp, Artificial Sequence
  Description of Artificial Sequence: Synthetic oligonucleotide
  Target: ANGPTL3; (+) strand; PAM type: YTN; PAM sequence: CTT
tttacttgggaaatcacgaa

SEQ ID NO: 15746 - DNA, 20 bp, Artificial Sequence
  Description of Artificial Sequence: Synthetic oligonucleotide
  Target: ANGPTL3; (+) strand; PAM type: YTN; PAM sequence: TTT
ttacttgggaaatcacgaaa

SEQ ID NO: 15747 - DNA, 20 bp, Artificial Sequence
  Description of Artificial Sequence: Synthetic oligonucleotide
  Target: ANGPTL3; (+) strand; PAM type: YTN; PAM sequence: TTT
tacttgggaaatcacgaaac

SEQ ID NO: 15748 - DNA, 20 bp, Artificial Sequence
  Description of Artificial Sequence: Synthetic oligonucleotide
  Target: ANGPTL3; (+) strand; PAM type: YTN; PAM sequence: TTT
acttgggaaatcacgaaacc

SEQ ID NO: 15749 - DNA, 20 bp, Artificial Sequence
  Description of Artificial Sequence: Synthetic oligonucleotide
  Target: ANGPTL3; (+) strand; PAM type: YTN; PAM sequence: TTA
cttgggaaatcacgaaacca

SEQ ID NO: 15750 - DNA, 20 bp, Artificial Sequence
  Description of Artificial Sequence: Synthetic oligonucleotide
  Target: ANGPTL3; (+) strand; PAM type: YTN; PAM sequence: CTT
gggaaatcacgaaaccaact

SEQ ID NO: 15751 - DNA, 20 bp, Artificial Sequence
  Description of Artificial Sequence: Synthetic oligonucleotide
  Target: ANGPTL3; (+) strand; PAM type: YTN; PAM sequence: TTG
ggaaatcacgaaaccaacta

SEQ ID NO: 15752 - DNA, 20 bp, Artificial Sequence
  Description of Artificial Sequence: Synthetic oligonucleotide
  Target: ANGPTL3; (+) strand; PAM type: YTN; PAM sequence: CTA
tacgctacatctagttgcga

SEQ ID NO: 15753 - DNA, 20 bp, Artificial Sequence
  Description of Artificial Sequence: Synthetic oligonucleotide
  Target: ANGPTL3; (+) strand; PAM type: YTN; PAM sequence: CTA
catctagttgcgattactgg

SEQ ID NO: 15754 - DNA, 20 bp, Artificial Sequence
  Description of Artificial Sequence: Synthetic oligonucleotide
  Target: ANGPTL3; (+) strand; PAM type: YTN; PAM sequence: CTA
gttgcgattactggcaatgt

SEQ ID NO: 15755 - DNA, 20 bp, Artificial Sequence
  Description of Artificial Sequence: Synthetic oligonucleotide
  Target: ANGPTL3; (+) strand; PAM type: YTN; PAM sequence: TTG
cgattactggcaatgtcccc

SEQ ID NO: 15756 - DNA, 20 bp, Artificial Sequence
  Description of Artificial Sequence: Synthetic oligonucleotide
  Target: ANGPTL3; (+) strand; PAM type: YTN; PAM sequence: TTA
ctggcaatgtccccaatgca

SEQ ID NO: 15757 - DNA, 20 bp, Artificial Sequence
  Description of Artificial Sequence: Synthetic oligonucleotide
  Target: ANGPTL3; (+) strand; PAM type: YTN; PAM sequence: CTG
gcaatgtccccaatgcaatc

SEQ ID NO: 15758 - DNA, 20 bp, Artificial Sequence
  Description of Artificial Sequence: Synthetic oligonucleotide
  Target: ANGPTL3; (+) strand; PAM type: YTN; PAM sequence: TTT
ggtgttttctacttgggatc

SEQ ID NO: 15759 - DNA, 20 bp, Artificial Sequence
  Description of Artificial Sequence: Synthetic oligonucleotide
  Target: ANGPTL3; (+) strand; PAM type: YTN; PAM sequence: TTG
gtgttttctacttgggatca

SEQ ID NO: 15760 - DNA, 20 bp, Artificial Sequence
  Description of Artificial Sequence: Synthetic oligonucleotide
  Target: ANGPTL3; (+) strand; PAM type: YTN; PAM sequence: TTT
tctacttgggatcacaaagc

SEQ ID NO: 15761 - DNA, 20 bp, Artificial Sequence
  Description of Artificial Sequence: Synthetic oligonucleotide
  Target: ANGPTL3; (+) strand; PAM type: YTN; PAM sequence: TTT
ctacttgggatcacaaagca

SEQ ID NO: 15762 - DNA, 20 bp, Artificial Sequence
  Description of Artificial Sequence: Synthetic oligonucleotide
  Target: ANGPTL3; (+) strand; PAM type: YTN; PAM sequence: TTC
tacttgggatcacaaagcaa

SEQ ID NO: 15763 - DNA, 20 bp, Artificial Sequence
  Description of Artificial Sequence: Synthetic oligonucleotide
  Target: ANGPTL3; (+) strand; PAM type: YTN; PAM sequence: CTA
cttgggatcacaaagcaaaa

SEQ ID NO: 15764 - DNA, 20 bp, Artificial Sequence
  Description of Artificial Sequence: Synthetic oligonucleotide
  Target: ANGPTL3; (+) strand; PAM type: YTN; PAM sequence: CTT
gggatcacaaagcaaaagga

SEQ ID NO: 15765 - DNA, 20 bp, Artificial Sequence
  Description of Artificial Sequence: Synthetic oligonucleotide
  Target: ANGPTL3; (+) strand; PAM type: YTN; PAM sequence: TTG
ggatcacaaagcaaaaggac

SEQ ID NO: 15766 - DNA, 20 bp, Artificial Sequence
  Description of Artificial Sequence: Synthetic oligonucleotide
  Target: ANGPTL3; (+) strand; PAM type: YTN; PAM sequence: CTT
caactgtccagagggttatt

SEQ ID NO: 15767 - DNA, 20 bp, Artificial Sequence
  Description of Artificial Sequence: Synthetic oligonucleotide
  Target: ANGPTL3; (+) strand; PAM type: YTN; PAM sequence: TTC
aactgtccagagggttattc

SEQ ID NO: 15768 - DNA, 20 bp, Artificial Sequence
  Description of Artificial Sequence: Synthetic oligonucleotide
  Target: ANGPTL3; (+) strand; PAM type: YTN; PAM sequence: CTG
tccagagggttattcaggta

SEQ ID NO: 15769 - DNA, 20 bp, Artificial Sequence
  Description of Artificial Sequence: Synthetic oligonucleotide
  Target: ANGPTL3; (+) strand; PAM type: YTN; PAM sequence: TTA
ttcaggtatctttttctgat

SEQ ID NO: 15770 - DNA, 20 bp, Artificial Sequence
  Description of Artificial Sequence: Synthetic oligonucleotide
  Target: ANGPTL3; (+) strand; PAM type: YTN; PAM sequence: TTC
aggtatctttttctgatacc

SEQ ID NO: 15771 - DNA, 20 bp, Artificial Sequence
  Description of Artificial Sequence: Synthetic oligonucleotide
  Target: ANGPTL3; (+) strand; PAM type: YTN; PAM sequence: CTT
tttctgataccaatacttta

SEQ ID NO: 15772 - DNA, 20 bp, Artificial Sequence
  Description of Artificial Sequence: Synthetic oligonucleotide
  Target: ANGPTL3; (+) strand; PAM type: YTN; PAM sequence: TTT
ttctgataccaatactttat

SEQ ID NO: 15773 - DNA, 20 bp, Artificial Sequence
  Description of Artificial Sequence: Synthetic oligonucleotide
  Target: ANGPTL3; (+) strand; PAM type: YTN; PAM sequence: TTT
tctgataccaatactttatt

SEQ ID NO: 15774 - DNA, 20 bp, Artificial Sequence
  Description of Artificial Sequence: Synthetic oligonucleotide
  Target: ANGPTL3; (+) strand; PAM type: YTN; PAM sequence: TTT
ctgataccaatactttattt

SEQ ID NO: 15775 - DNA, 20 bp, Artificial Sequence
  Description of Artificial Sequence: Synthetic oligonucleotide
  Target: ANGPTL3; (+) strand; PAM type: YTN; PAM sequence: TTC
tgataccaatactttatttt

SEQ ID NO: 15776 - DNA, 20 bp, Artificial Sequence
  Description of Artificial Sequence: Synthetic oligonucleotide
  Target: ANGPTL3; (+) strand; PAM type: YTN; PAM sequence: CTG
ataccaatactttattttca

SEQ ID NO: 15777 - DNA, 20 bp, Artificial Sequence
  Description of Artificial Sequence: Synthetic oligonucleotide
  Target: ANGPTL3; (+) strand; PAM type: YTN; PAM sequence: CTT
tattttcatatcttcaaagt

SEQ ID NO: 15778 - DNA, 20 bp, Artificial Sequence
  Description of Artificial Sequence: Synthetic oligonucleotide
  Target: ANGPTL3; (+) strand; PAM type: YTN; PAM sequence: TTT
attttcatatcttcaaagta

SEQ ID NO: 15779 - DNA, 20 bp, Artificial Sequence
  Description of Artificial Sequence: Synthetic oligonucleotide
  Target: ANGPTL3; (+) strand; PAM type: YTN; PAM sequence: TTA
ttttcatatcttcaaagtat

SEQ ID NO: 15780 - DNA, 20 bp, Artificial Sequence
  Description of Artificial Sequence: Synthetic oligonucleotide
  Target: ANGPTL3; (+) strand; PAM type: YTN; PAM sequence: TTT
tcatatcttcaaagtatctt

SEQ ID NO: 15781 - DNA, 20 bp, Artificial Sequence
  Description of Artificial Sequence: Synthetic oligonucleotide
  Target: ANGPTL3; (+) strand; PAM type: YTN; PAM sequence: TTT
catatcttcaaagtatcttc

SEQ ID NO: 15782 - DNA, 20 bp, Artificial Sequence
  Description of Artificial Sequence: Synthetic oligonucleotide
  Target: ANGPTL3; (+) strand; PAM type: YTN; PAM sequence: TTC
atatcttcaaagtatcttcc

SEQ ID NO: 15783 - DNA, 20 bp, Artificial Sequence
  Description of Artificial Sequence: Synthetic oligonucleotide
  Target: ANGPTL3; (+) strand; PAM type: YTN; PAM sequence: CTT
caaagtatcttcccacatta

SEQ ID NO: 15784 - DNA, 20 bp, Artificial Sequence
  Description of Artificial Sequence: Synthetic oligonucleotide
  Target: ANGPTL3; (+) strand; PAM type: YTN; PAM sequence: TTC
aaagtatcttcccacattat

SEQ ID NO: 15785 - DNA, 20 bp, Artificial Sequence
  Description of Artificial Sequence: Synthetic oligonucleotide
  Target: ANGPTL3; (+) strand; PAM type: YTN; PAM sequence: CTT
cccacattattagctattat

SEQ ID NO: 15786 - DNA, 20 bp, Artificial Sequence
  Description of Artificial Sequence: Synthetic oligonucleotide
  Target: ANGPTL3; (+) strand; PAM type: YTN; PAM sequence: TTC
ccacattattagctattatc

SEQ ID NO: 15787 - DNA, 20 bp, Artificial Sequence
  Description of Artificial Sequence: Synthetic oligonucleotide
  Target: ANGPTL3; (+) strand; PAM type: YTN; PAM sequence: TTA
ttagctattatctgcaatga

SEQ ID NO: 15788 - DNA, 20 bp, Artificial Sequence
  Description of Artificial Sequence: Synthetic oligonucleotide
  Target: ANGPTL3; (+) strand; PAM type: YTN; PAM sequence: TTA
gctattatctgcaatgacaa

SEQ ID NO: 15789 - DNA, 20 bp, Artificial Sequence
  Description of Artificial Sequence: Synthetic oligonucleotide
  Target: ANGPTL3; (+) strand; PAM type: YTN; PAM sequence: CTA
ttatctgcaatgacaacttt

SEQ ID NO: 15790 - DNA, 20 bp, Artificial Sequence
  Description of Artificial Sequence: Synthetic oligonucleotide
  Target: ANGPTL3; (+) strand; PAM type: YTN; PAM sequence: TTA
tctgcaatgacaacttttaa

SEQ ID NO: 15791 - DNA, 20 bp, Artificial Sequence
  Description of Artificial Sequence: Synthetic oligonucleotide
  Target: ANGPTL3; (+) strand; PAM type: YTN; PAM sequence: CTG
caatgacaacttttaaaaat

SEQ ID NO: 15792 - DNA, 20 bp, Artificial Sequence
  Description of Artificial Sequence: Synthetic oligonucleotide
  Target: ANGPTL3; (+) strand; PAM type: YTN; PAM sequence: CTT
ttaaaaatccgaatcccaaa

SEQ ID NO: 15793 - DNA, 20 bp, Artificial Sequence
  Description of Artificial Sequence: Synthetic oligonucleotide
  Target: ANGPTL3; (+) strand; PAM type: YTN; PAM sequence: TTT
taaaaatccgaatcccaaat

SEQ ID NO: 15794 - DNA, 20 bp, Artificial Sequence
  Description of Artificial Sequence: Synthetic oligonucleotide
  Target: ANGPTL3; (+) strand; PAM type: YTN; PAM sequence: TTT
aaaaatccgaatcccaaata

SEQ ID NO: 15795 - DNA, 20 bp, Artificial Sequence
  Description of Artificial Sequence: Synthetic oligonucleotide
  Target: ANGPTL3; (+) strand; PAM type: YTN; PAM sequence: TTA
aaaatccgaatcccaaataa

SEQ ID NO: 15796 - DNA, 20 bp, Artificial Sequence
  Description of Artificial Sequence: Synthetic oligonucleotide
  Target: ANGPTL3; (+) strand; PAM type: YTN; PAM sequence: TTT
tctctctagacgaaaacctc

SEQ ID NO: 15797 - DNA, 20 bp, Artificial Sequence
  Description of Artificial Sequence: Synthetic oligonucleotide
  Target: ANGPTL3; (+) strand; PAM type: YTN; PAM sequence: TTT
ctctctagacgaaaacctct

SEQ ID NO: 15798 - DNA, 20 bp, Artificial Sequence
  Description of Artificial Sequence: Synthetic oligonucleotide
  Target: ANGPTL3; (+) strand; PAM type: YTN; PAM sequence: TTC
tctctagacgaaaacctctt

SEQ ID NO: 15799 - DNA, 20 bp, Artificial Sequence
  Description of Artificial Sequence: Synthetic oligonucleotide
  Target: ANGPTL3; (+) strand; PAM type: YTN; PAM sequence: CTC
tctagacgaaaacctcttaa

SEQ ID NO: 15800 - DNA, 20 bp, Artificial Sequence
  Description of Artificial Sequence: Synthetic oligonucleotide
  Target: ANGPTL3; (+) strand; PAM type: YTN; PAM sequence: CTC
tagacgaaaacctcttaact

SEQ ID NO: 15801 - DNA, 20 bp, Artificial Sequence
  Description of Artificial Sequence: Synthetic oligonucleotide
  Target: ANGPTL3; (+) strand; PAM type: YTN; PAM sequence: CTA
gacgaaaacctcttaactat

SEQ ID NO: 15802 - DNA, 20 bp, Artificial Sequence
  Description of Artificial Sequence: Synthetic oligonucleotide
  Target: ANGPTL3; (+) strand; PAM type: YTN; PAM sequence: CTC
ttaactataatgaaagtgtt

SEQ ID NO: 15803 - DNA, 20 bp, Artificial Sequence
  Description of Artificial Sequence: Synthetic oligonucleotide
  Target: ANGPTL3; (+) strand; PAM type: YTN; PAM sequence: CTT
aactataatgaaagtgttca

SEQ ID NO: 15804 - DNA, 20 bp, Artificial Sequence
  Description of Artificial Sequence: Synthetic oligonucleotide
  Target: ANGPTL3; (+) strand; PAM type: YTN; PAM sequence: TTA
actataatgaaagtgttcat

SEQ ID NO: 15805 - DNA, 20 bp, Artificial Sequence
  Description of Artificial Sequence: Synthetic oligonucleotide
  Target: ANGPTL3; (+) strand; PAM type: YTN; PAM sequence: CTA
taatgaaagtgttcattcta

SEQ ID NO: 15806 - DNA, 20 bp, Artificial Sequence
  Description of Artificial Sequence: Synthetic oligonucleotide
  Target: ANGPTL3; (+) strand; PAM type: YTN; PAM sequence: TTC
attctagttcaatcaggtat

SEQ ID NO: 15807 - DNA, 20 bp, Artificial Sequence
  Description of Artificial Sequence: Synthetic oligonucleotide
  Target: ANGPTL3; (+) strand; PAM type: YTN; PAM sequence: TTC
tagttcaatcaggtatttta

SEQ ID NO: 15808 - DNA, 20 bp, Artificial Sequence
  Description of Artificial Sequence: Synthetic oligonucleotide
  Target: ANGPTL3; (+) strand; PAM type: YTN; PAM sequence: CTA
gttcaatcaggtattttacc

SEQ ID NO: 15809 - DNA, 20 bp, Artificial Sequence
  Description of Artificial Sequence: Synthetic oligonucleotide
  Target: ANGPTL3; (+) strand; PAM type: YTN; PAM sequence: TTC
aatcaggtattttacctcta

SEQ ID NO: 15810 - DNA, 20 bp, Artificial Sequence
  Description of Artificial Sequence: Synthetic oligonucleotide
  Target: ANGPTL3; (+) strand; PAM type: YTN; PAM sequence: TTT
tacctctaatcttcctcaga

SEQ ID NO: 15811 - DNA, 20 bp, Artificial Sequence
  Description of Artificial Sequence: Synthetic oligonucleotide
  Target: ANGPTL3; (+) strand; PAM type: YTN; PAM sequence: TTT
acctctaatcttcctcagat

SEQ ID NO: 15812 - DNA, 20 bp, Artificial Sequence
  Description of Artificial Sequence: Synthetic oligonucleotide
  Target: ANGPTL3; (+) strand; PAM type: YTN; PAM sequence: TTA
cctctaatcttcctcagatt

SEQ ID NO: 15813 - DNA, 20 bp, Artificial Sequence
  Description of Artificial Sequence: Synthetic oligonucleotide
  Target: ANGPTL3; (+) strand; PAM type: YTN; PAM sequence: CTC
taatcttcctcagattttct

SEQ ID NO: 15814 - DNA, 20 bp, Artificial Sequence
  Description of Artificial Sequence: Synthetic oligonucleotide
  Target: ANGPTL3; (+) strand; PAM type: YTN; PAM sequence: CTA
atcttcctcagattttctat

SEQ ID NO: 15815 - DNA, 20 bp, Artificial Sequence
  Description of Artificial Sequence: Synthetic oligonucleotide
  Target: ANGPTL3; (+) strand; PAM type: YTN; PAM sequence: CTT
cctcagattttctatttttt

SEQ ID NO: 15816 - DNA, 20 bp, Artificial Sequence
  Description of Artificial Sequence: Synthetic oligonucleotide
  Target: ANGPTL3; (+) strand; PAM type: YTN; PAM sequence: TTC
ctcagattttctattttttg

SEQ ID NO: 15817 - DNA, 20 bp, Artificial Sequence
  Description of Artificial Sequence: Synthetic oligonucleotide
  Target: ANGPTL3; (+) strand; PAM type: YTN; PAM sequence: CTC
agattttctattttttggta

SEQ ID NO: 15818 - DNA, 20 bp, Artificial Sequence
  Description of Artificial Sequence: Synthetic oligonucleotide
  Target: ANGPTL3; (+) strand; PAM type: YTN; PAM sequence: TTT
tctattttttggtagtgtat

SEQ ID NO: 15819 - DNA, 20 bp, Artificial Sequence
  Description of Artificial Sequence: Synthetic oligonucleotide
  Target: ANGPTL3; (+) strand; PAM type: YTN; PAM sequence: TTT
ctattttttggtagtgtata

SEQ ID NO: 15820 - DNA, 20 bp, Artificial Sequence
  Description of Artificial Sequence: Synthetic oligonucleotide
  Target: ANGPTL3; (+) strand; PAM type: YTN; PAM sequence: TTC
tattttttggtagtgtatag

SEQ ID NO: 15821 - DNA, 20 bp, Artificial Sequence
  Description of Artificial Sequence: Synthetic oligonucleotide
  Target: ANGPTL3; (+) strand; PAM type: YTN; PAM sequence: CTA
ttttttggtagtgtatagat

SEQ ID NO: 15822 - DNA, 20 bp, Artificial Sequence
  Description of Artificial Sequence: Synthetic oligonucleotide
  Target: ANGPTL3; (+) strand; PAM type: YTN; PAM sequence: TTT
tttggtagtgtatagattat

SEQ ID NO: 15823 - DNA, 20 bp, Artificial Sequence
  Description of Artificial Sequence: Synthetic oligonucleotide
  Target: ANGPTL3; (+) strand; PAM type: YTN; PAM sequence: TTT
ttggtagtgtatagattatt

SEQ ID NO: 15824 - DNA, 20 bp, Artificial Sequence
  Description of Artificial Sequence: Synthetic oligonucleotide
  Target: ANGPTL3; (+) strand; PAM type: YTN; PAM sequence: TTT
tggtagtgtatagattattt

SEQ ID NO: 15825 - DNA, 20 bp, Artificial Sequence
  Description of Artificial Sequence: Synthetic oligonucleotide
  Target: ANGPTL3; (+) strand; PAM type: YTN; PAM sequence: TTT
ggtagtgtatagattattta

SEQ ID NO: 15826 - DNA, 20 bp, Artificial Sequence
  Description of Artificial Sequence: Synthetic oligonucleotide
  Target: ANGPTL3; (+) strand; PAM type: YTN; PAM sequence: TTG
gtagtgtatagattatttat

SEQ ID NO: 15827 - DNA, 20 bp, Artificial Sequence
  Description of Artificial Sequence: Synthetic oligonucleotide
  Target: ANGPTL3; (+) strand; PAM type: YTN; PAM sequence: TTA
tttatacagattatttaaaa

SEQ ID NO: 15828 - DNA, 20 bp, Artificial Sequence
  Description of Artificial Sequence: Synthetic oligonucleotide
  Target: ANGPTL3; (+) strand; PAM type: YTN; PAM sequence: TTT
atacagattatttaaaattg

SEQ ID NO: 15829 - DNA, 20 bp, Artificial Sequence
  Description of Artificial Sequence: Synthetic oligonucleotide
  Target: ANGPTL3; (+) strand; PAM type: YTN; PAM sequence: TTA
tacagattatttaaaattgg

SEQ ID NO: 15830 - DNA, 20 bp, Artificial Sequence
  Description of Artificial Sequence: Synthetic oligonucleotide
  Target: ANGPTL3; (+) strand; PAM type: YTN; PAM sequence: TTA
tttaaaattgggacttatac

SEQ ID NO: 15831 - DNA, 20 bp, Artificial Sequence
  Description of Artificial Sequence: Synthetic oligonucleotide
  Target: ANGPTL3; (+) strand; PAM type: YTN; PAM sequence: TTT
aaaattgggacttatacaga

SEQ ID NO: 15832 - DNA, 20 bp, Artificial Sequence
  Description of Artificial Sequence: Synthetic oligonucleotide
  Target: ANGPTL3; (+) strand; PAM type: YTN; PAM sequence: TTA
aaattgggacttatacagat

SEQ ID NO: 15833 - DNA, 20 bp, Artificial Sequence
  Description of Artificial Sequence: Synthetic oligonucleotide
  Target: ANGPTL3; (+) strand; PAM type: YTN; PAM sequence: TTG
ggacttatacagattattta

SEQ ID NO: 15834 - DNA, 20 bp, Artificial Sequence
  Description of Artificial Sequence: Synthetic oligonucleotide
  Target: ANGPTL3; (+) strand; PAM type: YTN; PAM sequence: CTT
atacagattatttaaaactg

SEQ ID NO: 15835 - DNA, 20 bp, Artificial Sequence
  Description of Artificial Sequence: Synthetic oligonucleotide
  Target: ANGPTL3; (+) strand; PAM type: YTN; PAM sequence: TTA
tacagattatttaaaactgg

SEQ ID NO: 15836 - DNA, 20 bp, Artificial Sequence
  Description of Artificial Sequence: Synthetic oligonucleotide
  Target: ANGPTL3; (+) strand; PAM type: YTN; PAM sequence: TTA
tttaaaactgggatacatgc

SEQ ID NO: 15837 - DNA, 20 bp, Artificial Sequence
  Description of Artificial Sequence: Synthetic oligonucleotide
  Target: ANGPTL3; (+) strand; PAM type: YTN; PAM sequence: TTT
aaaactgggatacatgcatc

SEQ ID NO: 15838 - DNA, 20 bp, Artificial Sequence
  Description of Artificial Sequence: Synthetic oligonucleotide
  Target: ANGPTL3; (+) strand; PAM type: YTN; PAM sequence: TTA
aaactgggatacatgcatct

SEQ ID NO: 15839 - DNA, 20 bp, Artificial Sequence
  Description of Artificial Sequence: Synthetic oligonucleotide
  Target: ANGPTL3; (+) strand; PAM type: YTN; PAM sequence: CTG
ggatacatgcatctaaaaca

SEQ ID NO: 15840 - DNA, 20 bp, Artificial Sequence
  Description of Artificial Sequence: Synthetic oligonucleotide
  Target: ANGPTL3; (+) strand; PAM type: YTN; PAM sequence: CTA
aaacactgtaatatttataa

SEQ ID NO: 15841 - DNA, 20 bp, Artificial Sequence
  Description of Artificial Sequence: Synthetic oligonucleotide
  Target: ANGPTL3; (+) strand; PAM type: YTN; PAM sequence: CTG
taatatttataagaaaggaa

SEQ ID NO: 15842 - DNA, 20 bp, Artificial Sequence
  Description of Artificial Sequence: Synthetic oligonucleotide
  Target: ANGPTL3; (+) strand; PAM type: YTN; PAM sequence: TTT
ataagaaaggaagataaact

SEQ ID NO: 15843 - DNA, 20 bp, Artificial Sequence
  Description of Artificial Sequence: Synthetic oligonucleotide
  Target: ANGPTL3; (+) strand; PAM type: YTN; PAM sequence: TTA
taagaaaggaagataaactt

SEQ ID NO: 15844 - DNA, 20 bp, Artificial Sequence
  Description of Artificial Sequence: Synthetic oligonucleotide
  Target: ANGPTL3; (+) strand; PAM type: YTN; PAM sequence: CTT
acggggaaatacagtaacag

SEQ ID NO: 15845 - DNA, 20 bp, Artificial Sequence
  Description of Artificial Sequence: Synthetic oligonucleotide
  Target: ANGPTL3; (+) strand; PAM type: YTN; PAM sequence: TTA
cggggaaatacagtaacagt

SEQ ID NO: 15846 - DNA, 20 bp, Artificial Sequence
  Description of Artificial Sequence: Synthetic oligonucleotide
  Target: ANGPTL3; (+) strand; PAM type: YTN; PAM sequence: CTA
catacgagtctgtacccatt

SEQ ID NO: 15847 - DNA, 20 bp, Artificial Sequence
  Description of Artificial Sequence: Synthetic oligonucleotide
  Target: ANGPTL3; (+) strand; PAM type: YTN; PAM sequence: CTG
tacccattaaattgcatatc

SEQ ID NO: 15848 - DNA, 20 bp, Artificial Sequence
  Description of Artificial Sequence: Synthetic oligonucleotide
  Target: ANGPTL3; (+) strand; PAM type: YTN; PAM sequence: TTA
aattgcatatctatctcctt

SEQ ID NO: 15849 - DNA, 20 bp, Artificial Sequence
  Description of Artificial Sequence: Synthetic oligonucleotide
  Target: ANGPTL3; (+) strand; PAM type: YTN; PAM sequence: TTG
catatctatctcctttagga

SEQ ID NO: 15850 - DNA, 20 bp, Artificial Sequence
  Description of Artificial Sequence: Synthetic oligonucleotide
  Target: ANGPTL3; (+) strand; PAM type: YTN; PAM sequence: CTA
tctcctttaggaggctggtg

SEQ ID NO: 15851 - DNA, 20 bp, Artificial Sequence
  Description of Artificial Sequence: Synthetic oligonucleotide
  Target: ANGPTL3; (+) strand; PAM type: YTN; PAM sequence: CTC
ctttaggaggctggtggtgg

SEQ ID NO: 15852 - DNA, 20 bp, Artificial Sequence
  Description of Artificial Sequence: Synthetic oligonucleotide
  Target: ANGPTL3; (+) strand; PAM type: YTN; PAM sequence: CTT
taggaggctggtggtggcat

SEQ ID NO: 15853 - DNA, 20 bp, Artificial Sequence
  Description of Artificial Sequence: Synthetic oligonucleotide
  Target: ANGPTL3; (+) strand; PAM type: YTN; PAM sequence: TTT
aggaggctggtggtggcatg

SEQ ID NO: 15854 - DNA, 20 bp, Artificial Sequence
  Description of Artificial Sequence: Synthetic oligonucleotide
  Target: ANGPTL3; (+) strand; PAM type: YTN; PAM sequence: TTA
ggaggctggtggtggcatga

SEQ ID NO: 15855 - DNA, 20 bp, Artificial Sequence
  Description of Artificial Sequence: Synthetic oligonucleotide
  Target: ANGPTL3; (+) strand; PAM type: YTN; PAM sequence: CTG
gtggtggcatgatgagtgtg

SEQ ID NO: 15856 - DNA, 20 bp, Artificial Sequence
  Description of Artificial Sequence: Synthetic oligonucleotide
  Target: ANGPTL3; (+) strand; PAM type: YTN; PAM sequence: CTA
aatggtaaatataacaaacc

SEQ ID NO: 15857 - DNA, 20 bp, Artificial Sequence
  Description of Artificial Sequence: Synthetic oligonucleotide
  Target: ANGPTL3; (+) strand; PAM type: YTN; PAM sequence: CTA
agccagagaggagaagagga

SEQ ID NO: 15858 - DNA, 20 bp, Artificial Sequence
  Description of Artificial Sequence: Synthetic oligonucleotide
  Target: ANGPTL3; (+) strand; PAM type: YTN; PAM sequence: TTA
tcttggaagtctcaaaatgg

SEQ ID NO: 15859 - DNA, 20 bp, Artificial Sequence
  Description of Artificial Sequence: Synthetic oligonucleotide
  Target: ANGPTL3; (+) strand; PAM type: YTN; PAM sequence: CTT
ggaagtctcaaaatggaagg

SEQ ID NO: 15860 - DNA, 20 bp, Artificial Sequence
  Description of Artificial Sequence: Synthetic oligonucleotide
  Target: ANGPTL3; (+) strand; PAM type: YTN; PAM sequence: TTG
gaagtctcaaaatggaaggt

SEQ ID NO: 15861 - DNA, 20 bp, Artificial Sequence
  Description of Artificial Sequence: Synthetic oligonucleotide
  Target: ANGPTL3; (+) strand; PAM type: YTN; PAM sequence: CTC
aaaatggaaggttatactct

SEQ ID NO: 15862 - DNA, 20 bp, Artificial Sequence
  Description of Artificial Sequence: Synthetic oligonucleotide
  Target: ANGPTL3; (+) strand; PAM type: YTN; PAM sequence: TTA
tactctataaaatcaaccaa

SEQ ID NO: 15863 - DNA, 20 bp, Artificial Sequence
  Description of Artificial Sequence: Synthetic oligonucleotide
  Target: ANGPTL3; (+) strand; PAM type: YTN; PAM sequence: CTC
tataaaatcaaccaaaatgt

SEQ ID NO: 15864 - DNA, 20 bp, Artificial Sequence
  Description of Artificial Sequence: Synthetic oligonucleotide
  Target: ANGPTL3; (+) strand; PAM type: YTN; PAM sequence: CTA
taaaatcaaccaaaatgttg

SEQ ID NO: 15865 - DNA, 20 bp, Artificial Sequence
  Description of Artificial Sequence: Synthetic oligonucleotide
  Target: ANGPTL3; (+) strand; PAM type: YTN; PAM sequence: TTG
atccatccaacagattcaga

SEQ ID NO: 15866 - DNA, 20 bp, Artificial Sequence
  Description of Artificial Sequence: Synthetic oligonucleotide
  Target: ANGPTL3; (+) strand; PAM type: YTN; PAM sequence: TTC
agaaagctttgaatgaactg

SEQ ID NO: 15867 - DNA, 20 bp, Artificial Sequence
  Description of Artificial Sequence: Synthetic oligonucleotide
  Target: ANGPTL3; (+) strand; PAM type: YTN; PAM sequence: CTT
tgaatgaactgaggcaaatt

SEQ ID NO: 15868 - DNA, 20 bp, Artificial Sequence
  Description of Artificial Sequence: Synthetic oligonucleotide
  Target: ANGPTL3; (+) strand; PAM type: YTN; PAM sequence: TTT
gaatgaactgaggcaaattt

SEQ ID NO: 15869 - DNA, 20 bp, Artificial Sequence
  Description of Artificial Sequence: Synthetic oligonucleotide
  Target: ANGPTL3; (+) strand; PAM type: YTN; PAM sequence: TTG
aatgaactgaggcaaattta

SEQ ID NO: 15870 - DNA, 20 bp, Artificial Sequence
  Description of Artificial Sequence: Synthetic oligonucleotide
  Target: ANGPTL3; (+) strand; PAM type: YTN; PAM sequence: CTG
aggcaaatttaaaaggcaat

SEQ ID NO: 15871 - DNA, 20 bp, Artificial Sequence
  Description of Artificial Sequence: Synthetic oligonucleotide
  Target: ANGPTL3; (+) strand; PAM type: YTN; PAM sequence: TTT
aaaaggcaataatttaaaca

SEQ ID NO: 15872 - DNA, 20 bp, Artificial Sequence
  Description of Artificial Sequence: Synthetic oligonucleotide
  Target: ANGPTL3; (+) strand; PAM type: YTN; PAM sequence: TTA
aaaggcaataatttaaacat

SEQ ID NO: 15873 - DNA, 20 bp, Artificial Sequence
  Description of Artificial Sequence: Synthetic oligonucleotide
  Target: ANGPTL3; (+) strand; PAM type: YTN; PAM sequence: TTT
aaacattaacctcattccaa

SEQ ID NO: 15874 - DNA, 20 bp, Artificial Sequence
  Description of Artificial Sequence: Synthetic oligonucleotide
  Target: ANGPTL3; (+) strand; PAM type: YTN; PAM sequence: TTA
aacattaacctcattccaag

SEQ ID NO: 15875 - DNA, 20 bp, Artificial Sequence
  Description of Artificial Sequence: Synthetic oligonucleotide
  Target: ANGPTL3; (+) strand; PAM type: YTN; PAM sequence: TTA
acctcattccaagttaatgt

SEQ ID NO: 15876 - DNA, 20 bp, Artificial Sequence
  Description of Artificial Sequence: Synthetic oligonucleotide
  Target: ANGPTL3; (+) strand; PAM type: YTN; PAM sequence: CTC
attccaagttaatgtggtct

SEQ ID NO: 15877 - DNA, 20 bp, Artificial Sequence
  Description of Artificial Sequence: Synthetic oligonucleotide
  Target: ANGPTL3; (+) strand; PAM type: YTN; PAM sequence: TTC
caagttaatgtggtctaata

SEQ ID NO: 15878 - DNA, 20 bp, Artificial Sequence
  Description of Artificial Sequence: Synthetic oligonucleotide
  Target: ANGPTL3; (+) strand; PAM type: YTN; PAM sequence: TTA
atgtggtctaataatctggt

SEQ ID NO: 15879 - DNA, 20 bp, Artificial Sequence
  Description of Artificial Sequence: Synthetic oligonucleotide
  Target: ANGPTL3; (+) strand; PAM type: YTN; PAM sequence: CTA
ataatctggtattaaatcct

SEQ ID NO: 15880 - DNA, 20 bp, Artificial Sequence
  Description of Artificial Sequence: Synthetic oligonucleotide
  Target: ANGPTL3; (+) strand; PAM type: YTN; PAM sequence: CTG
gtattaaatccttaagagaa

SEQ ID NO: 15881 - DNA, 20 bp, Artificial Sequence
  Description of Artificial Sequence: Synthetic oligonucleotide
  Target: ANGPTL3; (+) strand; PAM type: YTN; PAM sequence: TTA
aatccttaagagaaagcttg

SEQ ID NO: 15882 - DNA, 20 bp, Artificial Sequence
  Description of Artificial Sequence: Synthetic oligonucleotide
  Target: ANGPTL3; (+) strand; PAM type: YTN; PAM sequence: CTT
aagagaaagcttgagaaata

SEQ ID NO: 15883 - DNA, 20 bp, Artificial Sequence
  Description of Artificial Sequence: Synthetic oligonucleotide
  Target: ANGPTL3; (+) strand; PAM type: YTN; PAM sequence: TTA
agagaaagcttgagaaatag

SEQ ID NO: 15884 - DNA, 20 bp, Artificial Sequence
  Description of Artificial Sequence: Synthetic oligonucleotide
  Target: ANGPTL3; (+) strand; PAM type: YTN; PAM sequence: CTT
gagaaatagattttttttat

SEQ ID NO: 15885 - DNA, 20 bp, Artificial Sequence
  Description of Artificial Sequence: Synthetic oligonucleotide
  Target: ANGPTL3; (+) strand; PAM type: YTN; PAM sequence: TTG
agaaatagattttttttatc

SEQ ID NO: 15886 - DNA, 20 bp, Artificial Sequence
  Description of Artificial Sequence: Synthetic oligonucleotide
  Target: ANGPTL3; (+) strand; PAM type: YTN; PAM sequence: TTT
tttttatcttaaagtcactg

SEQ ID NO: 15887 - DNA, 20 bp, Artificial Sequence
  Description of Artificial Sequence: Synthetic oligonucleotide
  Target: ANGPTL3; (+) strand; PAM type: YTN; PAM sequence: TTT
ttttatcttaaagtcactgt

SEQ ID NO: 15888 - DNA, 20 bp, Artificial Sequence
  Description of Artificial Sequence: Synthetic oligonucleotide
  Target: ANGPTL3; (+) strand; PAM type: YTN; PAM sequence: TTT
tttatcttaaagtcactgtc

SEQ ID NO: 15889 - DNA, 20 bp, Artificial Sequence
  Description of Artificial Sequence: Synthetic oligonucleotide
  Target: ANGPTL3; (+) strand; PAM type: YTN; PAM sequence: TTT
ttatcttaaagtcactgtct

SEQ ID NO: 15890 - DNA, 20 bp, Artificial Sequence
  Description of Artificial Sequence: Synthetic oligonucleotide
  Target: ANGPTL3; (+) strand; PAM type: YTN; PAM sequence: TTT
tatcttaaagtcactgtcta

SEQ ID NO: 15891 - DNA, 20 bp, Artificial Sequence
  Description of Artificial Sequence: Synthetic oligonucleotide
  Target: ANGPTL3; (+) strand; PAM type: YTN; PAM sequence: TTT
atcttaaagtcactgtctat

SEQ ID NO: 15892 - DNA, 20 bp, Artificial Sequence
  Description of Artificial Sequence: Synthetic oligonucleotide
  Target: ANGPTL3; (+) strand; PAM type: YTN; PAM sequence: TTA
tcttaaagtcactgtctatt

SEQ ID NO: 15893 - DNA, 20 bp, Artificial Sequence
  Description of Artificial Sequence: Synthetic oligonucleotide
  Target: ANGPTL3; (+) strand; PAM type: YTN; PAM sequence: CTT
aaagtcactgtctatttaag

SEQ ID NO: 15894 - DNA, 20 bp, Artificial Sequence
  Description of Artificial Sequence: Synthetic oligonucleotide
  Target: ANGPTL3; (+) strand; PAM type: YTN; PAM sequence: TTA
aagtcactgtctatttaaga

SEQ ID NO: 15895 - DNA, 20 bp, Artificial Sequence
  Description of Artificial Sequence: Synthetic oligonucleotide
  Target: ANGPTL3; (+) strand; PAM type: YTN; PAM sequence: CTG
tctatttaagattaaacata

SEQ ID NO: 15896 - DNA, 20 bp, Artificial Sequence
  Description of Artificial Sequence: Synthetic oligonucleotide
  Target: ANGPTL3; (+) strand; PAM type: YTN; PAM sequence: CTA
tttaagattaaacatacaat

SEQ ID NO: 15897 - DNA, 20 bp, Artificial Sequence
  Description of Artificial Sequence: Synthetic oligonucleotide
  Target: ANGPTL3; (+) strand; PAM type: YTN; PAM sequence: TTT
aagattaaacatacaatcac

SEQ ID NO: 15898 - DNA, 20 bp, Artificial Sequence
  Description of Artificial Sequence: Synthetic oligonucleotide
  Target: ANGPTL3; (+) strand; PAM type: YTN; PAM sequence: TTA
agattaaacatacaatcaca

SEQ ID NO: 15899 - DNA, 20 bp, Artificial Sequence
  Description of Artificial Sequence: Synthetic oligonucleotide
  Target: ANGPTL3; (+) strand; PAM type: YTN; PAM sequence: TTA
aacatacaatcacataacct

SEQ ID NO: 15900 - DNA, 20 bp, Artificial Sequence
  Description of Artificial Sequence: Synthetic oligonucleotide
  Target: ANGPTL3; (+) strand; PAM type: YTN; PAM sequence: CTT
aaagaataccgtttacattt

SEQ ID NO: 15901 - DNA, 20 bp, Artificial Sequence
  Description of Artificial Sequence: Synthetic oligonucleotide
  Target: ANGPTL3; (+) strand; PAM type: YTN; PAM sequence: TTA
aagaataccgtttacatttc

SEQ ID NO: 15902 - DNA, 20 bp, Artificial Sequence
  Description of Artificial Sequence: Synthetic oligonucleotide
  Target: ANGPTL3; (+) strand; PAM type: YTN; PAM sequence: TTT
acatttctcaatcaaaattc

SEQ ID NO: 15903 - DNA, 20 bp, Artificial Sequence
  Description of Artificial Sequence: Synthetic oligonucleotide
  Target: ANGPTL3; (+) strand; PAM type: YTN; PAM sequence: TTA
catttctcaatcaaaattct

SEQ ID NO: 15904 - DNA, 20 bp, Artificial Sequence
  Description of Artificial Sequence: Synthetic oligonucleotide
  Target: ANGPTL3; (+) strand; PAM type: YTN; PAM sequence: TTT
ctcaatcaaaattcttataa

SEQ ID NO: 15905 - DNA, 20 bp, Artificial Sequence
  Description of Artificial Sequence: Synthetic oligonucleotide
  Target: ANGPTL3; (+) strand; PAM type: YTN; PAM sequence: TTC
tcaatcaaaattcttataat

SEQ ID NO: 15906 - DNA, 20 bp, Artificial Sequence
  Description of Artificial Sequence: Synthetic oligonucleotide
  Target: ANGPTL3; (+) strand; PAM type: YTN; PAM sequence: CTC
aatcaaaattcttataatac

SEQ ID NO: 15907 - DNA, 20 bp, Artificial Sequence
  Description of Artificial Sequence: Synthetic oligonucleotide
  Target: ANGPTL3; (+) strand; PAM type: YTN; PAM sequence: TTC
ttataatactatttgtttta

SEQ ID NO: 15908 - DNA, 20 bp, Artificial Sequence
  Description of Artificial Sequence: Synthetic oligonucleotide
  Target: ANGPTL3; (+) strand; PAM type: YTN; PAM sequence: CTT
ataatactatttgttttaaa

SEQ ID NO: 15909 - DNA, 20 bp, Artificial Sequence
  Description of Artificial Sequence: Synthetic oligonucleotide
  Target: ANGPTL3; (+) strand; PAM type: YTN; PAM sequence: TTA
taatactatttgttttaaat

SEQ ID NO: 15910 - DNA, 20 bp, Artificial Sequence
  Description of Artificial Sequence: Synthetic oligonucleotide
  Target: ANGPTL3; (+) strand; PAM type: YTN; PAM sequence: CTA
tttgttttaaattttgtgat

SEQ ID NO: 15911 - DNA, 20 bp, Artificial Sequence
  Description of Artificial Sequence: Synthetic oligonucleotide
  Target: ANGPTL3; (+) strand; PAM type: YTN; PAM sequence: TTT
gttttaaattttgtgatgtg

SEQ ID NO: 15912 - DNA, 20 bp, Artificial Sequence
  Description of Artificial Sequence: Synthetic oligonucleotide
  Target: ANGPTL3; (+) strand; PAM type: YTN; PAM sequence: TTG
ttttaaattttgtgatgtgg

SEQ ID NO: 15913 - DNA, 20 bp, Artificial Sequence
  Description of Artificial Sequence: Synthetic oligonucleotide
  Target: ANGPTL3; (+) strand; PAM type: YTN; PAM sequence: TTT
taaattttgtgatgtgggaa

SEQ ID NO: 15914 - DNA, 20 bp, Artificial Sequence
  Description of Artificial Sequence: Synthetic oligonucleotide
  Target: ANGPTL3; (+) strand; PAM type: YTN; PAM sequence: TTT
aaattttgtgatgtgggaat

SEQ ID NO: 15915 - DNA, 20 bp, Artificial Sequence
  Description of Artificial Sequence: Synthetic oligonucleotide
  Target: ANGPTL3; (+) strand; PAM type: YTN; PAM sequence: TTA
aattttgtgatgtgggaatc

SEQ ID NO: 15916 - DNA, 20 bp, Artificial Sequence
  Description of Artificial Sequence: Synthetic oligonucleotide
  Target: ANGPTL3; (+) strand; PAM type: YTN; PAM sequence: TTT
tgtgatgtgggaatcaattt

SEQ ID NO: 15917 - DNA, 20 bp, Artificial Sequence
  Description of Artificial Sequence: Synthetic oligonucleotide
  Target: ANGPTL3; (+) strand; PAM type: YTN; PAM sequence: TTT
gtgatgtgggaatcaatttt

SEQ ID NO: 15918 - DNA, 20 bp, Artificial Sequence
  Description of Artificial Sequence: Synthetic oligonucleotide
  Target: ANGPTL3; (+) strand; PAM type: YTN; PAM sequence: TTG
tgatgtgggaatcaatttta

SEQ ID NO: 15919 - DNA, 20 bp, Artificial Sequence
  Description of Artificial Sequence: Synthetic oligonucleotide
  Target: ANGPTL3; (+) strand; PAM type: YTN; PAM sequence: TTT
tagatggtcacaatctagat

SEQ ID NO: 15920 - DNA, 20 bp, Artificial Sequence
  Description of Artificial Sequence: Synthetic oligonucleotide
  Target: ANGPTL3; (+) strand; PAM type: YTN; PAM sequence: TTT
agatggtcacaatctagatt

SEQ ID NO: 15921 - DNA, 20 bp, Artificial Sequence
  Description of Artificial Sequence: Synthetic oligonucleotide
  Target: ANGPTL3; (+) strand; PAM type: YTN; PAM sequence: TTA
gatggtcacaatctagatta

SEQ ID NO: 15922 - DNA, 20 bp, Artificial Sequence
  Description of Artificial Sequence: Synthetic oligonucleotide
  Target: ANGPTL3; (+) strand; PAM type: YTN; PAM sequence: CTA
gattataatcaataggtgaa

SEQ ID NO: 15923 - DNA, 20 bp, Artificial Sequence
  Description of Artificial Sequence: Synthetic oligonucleotide
  Target: ANGPTL3; (+) strand; PAM type: YTN; PAM sequence: TTA
taatcaataggtgaacttat

SEQ ID NO: 15924 - DNA, 20 bp, Artificial Sequence
  Description of Artificial Sequence: Synthetic oligonucleotide
  Target: ANGPTL3; (+) strand; PAM type: YTN; PAM sequence: CTT
attaaataacttttctaaat

SEQ ID NO: 15925 - DNA, 20 bp, Artificial Sequence
  Description of Artificial Sequence: Synthetic oligonucleotide
  Target: ANGPTL3; (+) strand; PAM type: YTN; PAM sequence: TTA
ttaaataacttttctaaata

SEQ ID NO: 15926 - DNA, 20 bp, Artificial Sequence
  Description of Artificial Sequence: Synthetic oligonucleotide
  Target: ANGPTL3; (+) strand; PAM type: YTN; PAM sequence: TTA
aataacttttctaaataaaa

SEQ ID NO: 15927 - DNA, 20 bp, Artificial Sequence
  Description of Artificial Sequence: Synthetic oligonucleotide
  Target: ANGPTL3; (+) strand; PAM type: YTN; PAM sequence: CTT
ttctaaataaaaaatttaga

SEQ ID NO: 15928 - DNA, 20 bp, Artificial Sequence
  Description of Artificial Sequence: Synthetic oligonucleotide
  Target: ANGPTL3; (+) strand; PAM type: YTN; PAM sequence: TTT
tctaaataaaaaatttagag

SEQ ID NO: 15929 - DNA, 20 bp, Artificial Sequence
  Description of Artificial Sequence: Synthetic oligonucleotide
  Target: ANGPTL3; (+) strand; PAM type: YTN; PAM sequence: TTT
ctaaataaaaaatttagaga

SEQ ID NO: 15930 - DNA, 20 bp, Artificial Sequence
  Description of Artificial Sequence: Synthetic oligonucleotide
  Target: ANGPTL3; (+) strand; PAM type: YTN; PAM sequence: TTC
taaataaaaaatttagagac

SEQ ID NO: 15931 - DNA, 20 bp, Artificial Sequence
  Description of Artificial Sequence: Synthetic oligonucleotide
  Target: ANGPTL3; (+) strand; PAM type: YTN; PAM sequence: CTA
aataaaaaatttagagactt

SEQ ID NO: 15932 - DNA, 20 bp, Artificial Sequence
  Description of Artificial Sequence: Synthetic oligonucleotide
  Target: ANGPTL3; (+) strand; PAM type: YTN; PAM sequence: TTT
agagacttttattttaaaag

SEQ ID NO: 15933 - DNA, 20 bp, Artificial Sequence
  Description of Artificial Sequence: Synthetic oligonucleotide
  Target: ANGPTL3; (+) strand; PAM type: YTN; PAM sequence: TTA
gagacttttattttaaaagg

SEQ ID NO: 15934 - DNA, 20 bp, Artificial Sequence
  Description of Artificial Sequence: Synthetic oligonucleotide
  Target: ANGPTL3; (+) strand; PAM type: YTN; PAM sequence: CTT
ttattttaaaaggcatcata

SEQ ID NO: 15935 - DNA, 20 bp, Artificial Sequence
  Description of Artificial Sequence: Synthetic oligonucleotide
  Target: ANGPTL3; (+) strand; PAM type: YTN; PAM sequence: TTT
tattttaaaaggcatcatat

SEQ ID NO: 15936 - DNA, 20 bp, Artificial Sequence
  Description of Artificial Sequence: Synthetic oligonucleotide
  Target: ANGPTL3; (+) strand; PAM type: YTN; PAM sequence: TTT
attttaaaaggcatcatatg

SEQ ID NO: 15937 - DNA, 20 bp, Artificial Sequence
  Description of Artificial Sequence: Synthetic oligonucleotide
  Target: ANGPTL3; (+) strand; PAM type: YTN; PAM sequence: TTA
ttttaaaaggcatcatatga

SEQ ID NO: 15938 - DNA, 20 bp, Artificial Sequence
  Description of Artificial Sequence: Synthetic oligonucleotide
  Target: ANGPTL3; (+) strand; PAM type: YTN; PAM sequence: TTT
taaaaggcatcatatgagct

SEQ ID NO: 15939 - DNA, 20 bp, Artificial Sequence
  Description of Artificial Sequence: Synthetic oligonucleotide
  Target: ANGPTL3; (+) strand; PAM type: YTN; PAM sequence: TTT
aaaaggcatcatatgagcta

SEQ ID NO: 15940 - DNA, 20 bp, Artificial Sequence
  Description of Artificial Sequence: Synthetic oligonucleotide
  Target: ANGPTL3; (+) strand; PAM type: YTN; PAM sequence: TTA
aaaggcatcatatgagctaa

SEQ ID NO: 15941 - DNA, 20 bp, Artificial Sequence
  Description of Artificial Sequence: Synthetic oligonucleotide
  Target: ANGPTL3; (+) strand; PAM type: YTN; PAM sequence: CTA
atatcacaactttcccagtt

SEQ ID NO: 15942 - DNA, 20 bp, Artificial Sequence
  Description of Artificial Sequence: Synthetic oligonucleotide
  Target: ANGPTL3; (+) strand; PAM type: YTN; PAM sequence: CTT
tcccagtttaaaaaactagt

SEQ ID NO: 15943 - DNA, 20 bp, Artificial Sequence
  Description of Artificial Sequence: Synthetic oligonucleotide
  Target: ANGPTL3; (+) strand; PAM type: YTN; PAM sequence: TTT
cccagtttaaaaaactagta

SEQ ID NO: 15944 - DNA, 20 bp, Artificial Sequence
  Description of Artificial Sequence: Synthetic oligonucleotide
  Target: ANGPTL3; (+) strand; PAM type: YTN; PAM sequence: TTC
ccagtttaaaaaactagtac

SEQ ID NO: 15945 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaactagtactcttgtt

SEQ ID NO: 15946 - DNA, 20 bp, Artificial Sequence
  Description of Artificial Sequence: Synthetic oligonucleotide
  Target: ANGPTL3; (+) strand; PAM type: YTN; PAM sequence: TTA
aaaaactagtactcttgtta

SEQ ID NO: 15947 - DNA, 20 bp, Artificial Sequence
  Description of Artificial Sequence: Synthetic oligonucleotide
  Target: ANGPTL3; (+) strand; PAM type: YTN; PAM sequence: CTA
gtactcttgttaaaactcta

SEQ ID NO: 15948 - DNA, 20 bp, Artificial Sequence
  Description of Artificial Sequence: Synthetic oligonucleotide
  Target: ANGPTL3; (+) strand; PAM type: YTN; PAM sequence: CTC
ttgttaaaactctaaacttg

SEQ ID NO: 15949 - DNA, 20 bp, Artificial Sequence
  Description of Artificial Sequence: Synthetic oligonucleotide
  Target: ANGPTL3; (+) strand; PAM type: YTN; PAM sequence: CTT
gttaaaactctaaacttgac

SEQ ID NO: 15950 - DNA, 20 bp, Artificial Sequence
  Description of Artificial Sequence: Synthetic oligonucleotide
  Target: ANGPTL3; (+) strand; PAM type: YTN; PAM sequence: TTG
ttaaaactctaaacttgact

SEQ ID NO: 15951 - DNA, 20 bp, Artificial Sequence
  Description of Artificial Sequence: Synthetic oligonucleotide
  Target: ANGPTL3; (+) strand; PAM type: YTN; PAM sequence: TTA
aaactctaaacttgactaaa

SEQ ID NO: 15952 - DNA, 20 bp, Artificial Sequence
  Description of Artificial Sequence: Synthetic oligonucleotide
  Target: ANGPTL3; (+) strand; PAM type: YTN; PAM sequence: CTC
taaacttgactaaatacaga

SEQ ID NO: 15953 - DNA, 20 bp, Artificial Sequence
  Description of Artificial Sequence: Synthetic oligonucleotide
  Target: ANGPTL3; (+) strand; PAM type: YTN; PAM sequence: CTA
aacttgactaaatacagagg

SEQ ID NO: 15954 - DNA, 20 bp, Artificial Sequence
  Description of Artificial Sequence: Synthetic oligonucleotide
  Target: ANGPTL3; (+) strand; PAM type: YTN; PAM sequence: CTT
gactaaatacagaggactgg

SEQ ID NO: 15955 - DNA, 20 bp, Artificial Sequence
  Description of Artificial Sequence: Synthetic oligonucleotide
  Target: ANGPTL3; (+) strand; PAM type: YTN; PAM sequence: TTG
actaaatacagaggactggt

SEQ ID NO: 15956 - DNA, 20 bp, Artificial Sequence
  Description of Artificial Sequence: Synthetic oligonucleotide
  Target: ANGPTL3; (+) strand; PAM type: YTN; PAM sequence: CTA
aatacagaggactggtaatt

SEQ ID NO: 15957 - DNA, 20 bp, Artificial Sequence
  Description of Artificial Sequence: Synthetic oligonucleotide
  Target: ANGPTL3; (+) strand; PAM type: YTN; PAM sequence: CTG
gtaattgtacagttcttaaa

SEQ ID NO: 15958 - DNA, 20 bp, Artificial Sequence
  Description of Artificial Sequence: Synthetic oligonucleotide
  Target: ANGPTL3; (+) strand; PAM type: YTN; PAM sequence: TTG
tacagttcttaaatgttgta

SEQ ID NO: 15959 - DNA, 20 bp, Artificial Sequence
  Description of Artificial Sequence: Synthetic oligonucleotide
  Target: ANGPTL3; (+) strand; PAM type: YTN; PAM sequence: TTC
ttaaatgttgtagtattaat

SEQ ID NO: 15960 - DNA, 20 bp, Artificial Sequence
  Description of Artificial Sequence: Synthetic oligonucleotide
  Target: ANGPTL3; (+) strand; PAM type: YTN; PAM sequence: CTT
aaatgttgtagtattaattt

SEQ ID NO: 15961 - DNA, 20 bp, Artificial Sequence
  Description of Artificial Sequence: Synthetic oligonucleotide
  Target: ANGPTL3; (+) strand; PAM type: YTN; PAM sequence: TTA
aatgttgtagtattaatttc

SEQ ID NO: 15962 - DNA, 20 bp, Artificial Sequence
  Description of Artificial Sequence: Synthetic oligonucleotide
  Target: ANGPTL3; (+) strand; PAM type: YTN; PAM sequence: TTG
tagtattaatttcaaaacta

SEQ ID NO: 15963 - DNA, 20 bp, Artificial Sequence
  Description of Artificial Sequence: Synthetic oligonucleotide
  Target: ANGPTL3; (+) strand; PAM type: YTN; PAM sequence: TTA
atttcaaaactaaaaatcgt

SEQ ID NO: 15964 - DNA, 20 bp, Artificial Sequence
  Description of Artificial Sequence: Synthetic oligonucleotide
  Target: ANGPTL3; (+) strand; PAM type: YTN; PAM sequence: TTT
caaaactaaaaatcgtcagc

SEQ ID NO: 15965 - DNA, 20 bp, Artificial Sequence
  Description of Artificial Sequence: Synthetic oligonucleotide
  Target: ANGPTL3; (+) strand; PAM type: YTN; PAM sequence: TTC
aaaactaaaaatcgtcagca

SEQ ID NO: 15966 - DNA, 20 bp, Artificial Sequence
  Description of Artificial Sequence: Synthetic oligonucleotide
  Target: ANGPTL3; (+) strand; PAM type: YTN; PAM sequence: CTA
aaaatcgtcagcacagagta

SEQ ID NO: 15967 - DNA, 20 bp, Artificial Sequence
  Description of Artificial Sequence: Synthetic oligonucleotide
  Target: ANGPTL3; (+) strand; PAM type: YTN; PAM sequence: CTG
taatacaaatttttaaactg

SEQ ID NO: 15968 - DNA, 20 bp, Artificial Sequence
  Description of Artificial Sequence: Synthetic oligonucleotide
  Target: ANGPTL3; (+) strand; PAM type: YTN; PAM sequence: TTT
ttaaactgatgcttcatttt

SEQ ID NO: 15969 - DNA, 20 bp, Artificial Sequence
  Description of Artificial Sequence: Synthetic oligonucleotide
  Target: ANGPTL3; (+) strand; PAM type: YTN; PAM sequence: TTT
taaactgatgcttcattttg

SEQ ID NO: 15970 - DNA, 20 bp, Artificial Sequence
  Description of Artificial Sequence: Synthetic oligonucleotide
  Target: ANGPTL3; (+) strand; PAM type: YTN; PAM sequence: TTT
aaactgatgcttcattttgc

SEQ ID NO: 15971 - DNA, 20 bp, Artificial Sequence
  Description of Artificial Sequence: Synthetic oligonucleotide
  Target: ANGPTL3; (+) strand; PAM type: YTN; PAM sequence: TTA
aactgatgcttcattttgct

SEQ ID NO: 15972 - DNA, 20 bp, Artificial Sequence
  Description of Artificial Sequence: Synthetic oligonucleotide
  Target: ANGPTL3; (+) strand; PAM type: YTN; PAM sequence: CTG
atgcttcattttgctacaaa

SEQ ID NO: 15973 - DNA, 20 bp, Artificial Sequence
  Description of Artificial Sequence: Synthetic oligonucleotide
  Target: ANGPTL3; (+) strand; PAM type: YTN; PAM sequence: CTT
cattttgctacaaaataatt

SEQ ID NO: 15974 - DNA, 20 bp, Artificial Sequence
  Description of Artificial Sequence: Synthetic oligonucleotide
  Target: ANGPTL3; (+) strand; PAM type: YTN; PAM sequence: TTC
attttgctacaaaataattt

SEQ ID NO: 15975 - DNA, 20 bp, Artificial Sequence
  Description of Artificial Sequence: Synthetic oligonucleotide
  Target: ANGPTL3; (+) strand; PAM type: YTN; PAM sequence: TTT
tgctacaaaataatttggag

SEQ ID NO: 15976 - DNA, 20 bp, Artificial Sequence
  Description of Artificial Sequence: Synthetic oligonucleotide
  Target: ANGPTL3; (+) strand; PAM type: YTN; PAM sequence: TTT
gctacaaaataatttggagt

SEQ ID NO: 15977 - DNA, 20 bp, Artificial Sequence
  Description of Artificial Sequence: Synthetic oligonucleotide
  Target: ANGPTL3; (+) strand; PAM type: YTN; PAM sequence: TTG
ctacaaaataatttggagta

SEQ ID NO: 15978 - DNA, 20 bp, Artificial Sequence
  Description of Artificial Sequence: Synthetic oligonucleotide
  Target: ANGPTL3; (+) strand; PAM type: YTN; PAM sequence: CTA
caaaataatttggagtaaat

SEQ ID NO: 15979 - DNA, 20 bp, Artificial Sequence
  Description of Artificial Sequence: Synthetic oligonucleotide
  Target: ANGPTL3; (+) strand; PAM type: YTN; PAM sequence: TTT
ggagtaaatgtttgatatga

SEQ ID NO: 15980 - DNA, 20 bp, Artificial Sequence
  Description of Artificial Sequence: Synthetic oligonucleotide
  Target: ANGPTL3; (+) strand; PAM type: YTN; PAM sequence: TTG
gagtaaatgtttgatatgat

SEQ ID NO: 15981 - DNA, 20 bp, Artificial Sequence
  Description of Artificial Sequence: Synthetic oligonucleotide
  Target: ANGPTL3; (+) strand; PAM type: YTN; PAM sequence: TTT
gatatgatttatttatgaaa

SEQ ID NO: 15982 - DNA, 20 bp, Artificial Sequence
  Description of Artificial Sequence: Synthetic oligonucleotide
  Target: ANGPTL3; (+) strand; PAM type: YTN; PAM sequence: TTG
atatgatttatttatgaaac

SEQ ID NO: 15983 - DNA, 20 bp, Artificial Sequence
  Description of Artificial Sequence: Synthetic oligonucleotide
  Target: ANGPTL3; (+) strand; PAM type: YTN; PAM sequence: TTT
atttatgaaacctaatgaag

SEQ ID NO: 15984 - DNA, 20 bp, Artificial Sequence
  Description of Artificial Sequence: Synthetic oligonucleotide
  Target: ANGPTL3; (+) strand; PAM type: YTN; PAM sequence: TTA
tttatgaaacctaatgaagc

SEQ ID NO: 15985 - DNA, 20 bp, Artificial Sequence
  Description of Artificial Sequence: Synthetic oligonucleotide
  Target: ANGPTL3; (+) strand; PAM type: YTN; PAM sequence: TTT
atgaaacctaatgaagcaga

SEQ ID NO: 15986 - DNA, 20 bp, Artificial Sequence
  Description of Artificial Sequence: Synthetic oligonucleotide
  Target: ANGPTL3; (+) strand; PAM type: YTN; PAM sequence: TTA
tgaaacctaatgaagcagaa

SEQ ID NO: 15987 - DNA, 20 bp, Artificial Sequence
  Description of Artificial Sequence: Synthetic oligonucleotide
  Target: ANGPTL3; (+) strand; PAM type: YTN; PAM sequence: CTA
atgaagcagaattaaatact

SEQ ID NO: 15988 - DNA, 20 bp, Artificial Sequence
  Description of Artificial Sequence: Synthetic oligonucleotide
  Target: ANGPTL3; (+) strand; PAM type: YTN; PAM sequence: TTA
aatactgtattaaaataagt

SEQ ID NO: 15989 - DNA, 20 bp, Artificial Sequence
  Description of Artificial Sequence: Synthetic oligonucleotide
  Target: ANGPTL3; (+) strand; PAM type: YTN; PAM sequence: CTG
tattaaaataagttcgctgt

SEQ ID NO: 15990 - DNA, 20 bp, Artificial Sequence
  Description of Artificial Sequence: Synthetic oligonucleotide
  Target: ANGPTL3; (+) strand; PAM type: YTN; PAM sequence: TTA
aaataagttcgctgtcttta

SEQ ID NO: 15991 - DNA, 20 bp, Artificial Sequence
  Description of Artificial Sequence: Synthetic oligonucleotide
  Target: ANGPTL3; (+) strand; PAM type: YTN; PAM sequence: TTC
gctgtctttaaacaaatgga

SEQ ID NO: 15992 - DNA, 20 bp, Artificial Sequence
  Description of Artificial Sequence: Synthetic oligonucleotide
  Target: ANGPTL3; (+) strand; PAM type: YTN; PAM sequence: CTG
tctttaaacaaatggagatg

SEQ ID NO: 15993 - DNA, 20 bp, Artificial Sequence
  Description of Artificial Sequence: Synthetic oligonucleotide
  Target: ANGPTL3; (+) strand; PAM type: YTN; PAM sequence: CTT
taaacaaatggagatgacta

SEQ ID NO: 15994 - DNA, 20 bp, Artificial Sequence
  Description of Artificial Sequence: Synthetic oligonucleotide
  Target: ANGPTL3; (+) strand; PAM type: YTN; PAM sequence: TTT
aaacaaatggagatgactac

SEQ ID NO: 15995 - DNA, 20 bp, Artificial Sequence
  Description of Artificial Sequence: Synthetic oligonucleotide
  Target: ANGPTL3; (+) strand; PAM type: YTN; PAM sequence: TTA
aacaaatggagatgactact

SEQ ID NO: 15996 - DNA, 20 bp, Artificial Sequence
  Description of Artificial Sequence: Synthetic oligonucleotide
  Target: ANGPTL3; (+) strand; PAM type: YTN; PAM sequence: CTA
ctaagtcacattgactttaa

SEQ ID NO: 15997 - DNA, 20 bp, Artificial Sequence
  Description of Artificial Sequence: Synthetic oligonucleotide
  Target: ANGPTL3; (+) strand; PAM type: YTN; PAM sequence: CTA
agtcacattgactttaacat

SEQ ID NO: 15998 - DNA, 20 bp, Artificial Sequence
  Description of Artificial Sequence: Synthetic oligonucleotide
  Target: ANGPTL3; (+) strand; PAM type: YTN; PAM sequence: TTG
actttaacatgaggtatcac

SEQ ID NO: 15999 - DNA, 20 bp, Artificial Sequence
  Description of Artificial Sequence: Synthetic oligonucleotide
  Target: ANGPTL3; (+) strand; PAM type: YTN; PAM sequence: CTT
taacatgaggtatcactata

SEQ ID NO: 16000 - DNA, 20 bp, Artificial Sequence
  Description of Artificial Sequence: Synthetic oligonucleotide
  Target: ANGPTL3; (+) strand; PAM type: YTN; PAM sequence: TTT
aacatgaggtatcactatac

SEQ ID NO: 16001 - DNA, 20 bp, Artificial Sequence
  Description of Artificial Sequence: Synthetic oligonucleotide
  Target: ANGPTL3; (+) strand; PAM type: YTN; PAM sequence: TTA
acatgaggtatcactatacc

SEQ ID NO: 16002 - DNA, 20 bp, Artificial Sequence
  Description of Artificial Sequence: Synthetic oligonucleotide
  Target: ANGPTL3; (+) strand; PAM type: YTN; PAM sequence: CTA
taccttatttgttaaaatat

SEQ ID NO: 16003 - DNA, 20 bp, Artificial Sequence
  Description of Artificial Sequence: Synthetic oligonucleotide
  Target: ANGPTL3; (+) strand; PAM type: YTN; PAM sequence: CTT
atttgttaaaatatatactg

SEQ ID NO: 16004 - DNA, 20 bp, Artificial Sequence
  Description of Artificial Sequence: Synthetic oligonucleotide
  Target: ANGPTL3; (+) strand; PAM type: YTN; PAM sequence: TTA
tttgttaaaatatatactgt

SEQ ID NO: 16005 - DNA, 20 bp, Artificial Sequence
  Description of Artificial Sequence: Synthetic oligonucleotide
  Target: ANGPTL3; (+) strand; PAM type: YTN; PAM sequence: TTT
gttaaaatatatactgtata

SEQ ID NO: 16006 - DNA, 20 bp, Artificial Sequence
  Description of Artificial Sequence: Synthetic oligonucleotide
  Target: ANGPTL3; (+) strand; PAM type: YTN; PAM sequence: TTG
ttaaaatatatactgtatac

SEQ ID NO: 16007 - DNA, 20 bp, Artificial Sequence
  Description of Artificial Sequence: Synthetic oligonucleotide
  Target: ANGPTL3; (+) strand; PAM type: YTN; PAM sequence: TTA
aaatatatactgtatacatt

SEQ ID NO: 16008 - DNA, 20 bp, Artificial Sequence
  Description of Artificial Sequence: Synthetic oligonucleotide
  Target: ANGPTL3; (+) strand; PAM type: YTN; PAM sequence: CTG
tatacattttatatatttta

SEQ ID NO: 16009 - DNA, 20 bp, Artificial Sequence
  Description of Artificial Sequence: Synthetic oligonucleotide
  Target: ANGPTL3; (+) strand; PAM type: YTN; PAM sequence: TTT
tatatattttaacacttaat

SEQ ID NO: 16010 - DNA, 20 bp, Artificial Sequence
  Description of Artificial Sequence: Synthetic oligonucleotide
  Target: ANGPTL3; (+) strand; PAM type: YTN; PAM sequence: TTT
atatattttaacacttaata

SEQ ID NO: 16011 - DNA, 20 bp, Artificial Sequence
  Description of Artificial Sequence: Synthetic oligonucleotide
  Target: ANGPTL3; (+) strand; PAM type: YTN; PAM sequence: TTA
tatattttaacacttaatac

SEQ ID NO: 16012 - DNA, 20 bp, Artificial Sequence
  Description of Artificial Sequence: Synthetic oligonucleotide
  Target: ANGPTL3; (+) strand; PAM type: YTN; PAM sequence: TTT
taacacttaatactatgaaa

SEQ ID NO: 16013 - DNA, 20 bp, Artificial Sequence
  Description of Artificial Sequence: Synthetic oligonucleotide
  Target: ANGPTL3; (+) strand; PAM type: YTN; PAM sequence: TTT
aacacttaatactatgaaaa

SEQ ID NO: 16014 - DNA, 20 bp, Artificial Sequence
  Description of Artificial Sequence: Synthetic oligonucleotide
  Target: ANGPTL3; (+) strand; PAM type: YTN; PAM sequence: TTA
acacttaatactatgaaaac

SEQ ID NO: 16015 - DNA, 20 bp, Artificial Sequence
  Description of Artificial Sequence: Synthetic oligonucleotide
  Target: ANGPTL3; (+) strand; PAM type: YTN; PAM sequence: CTT
aatactatgaaaacaaataa

SEQ ID NO: 16016 - DNA, 20 bp, Artificial Sequence
  Description of Artificial Sequence: Synthetic oligonucleotide
  Target: ANGPTL3; (+) strand; PAM type: YTN; PAM sequence: TTA
atactatgaaaacaaataat

SEQ ID NO: 16017 - DNA, 20 bp, Artificial Sequence
  Description of Artificial Sequence: Synthetic oligonucleotide
  Target: ANGPTL3; (+) strand; PAM type: YTN; PAM sequence: CTA
tgaaaacaaataattgtaaa

SEQ ID NO: 16018 - DNA, 20 bp, Artificial Sequence
  Description of Artificial Sequence: Synthetic oligonucleotide
  Target: ANGPTL3; (+) strand; PAM type: YTN; PAM sequence: TTG
taaaggaatcttgtcagatt

SEQ ID NO: 16019 - DNA, 20 bp, Artificial Sequence
  Description of Artificial Sequence: Synthetic oligonucleotide
  Target: ANGPTL3; (+) strand; PAM type: YTN; PAM sequence: CTT
gtcagattacagtaagaatg

SEQ ID NO: 16020 - DNA, 20 bp, Artificial Sequence
  Description of Artificial Sequence: Synthetic oligonucleotide
  Target: ANGPTL3; (+) strand; PAM type: YTN; PAM sequence: TTG
tcagattacagtaagaatga

SEQ ID NO: 16021 - DNA, 20 bp, Artificial Sequence
  Description of Artificial Sequence: Synthetic oligonucleotide
  Target: ANGPTL3; (+) strand; PAM type: YTN; PAM sequence: TTA
cagtaagaatgaacatattt

SEQ ID NO: 16022 - DNA, 20 bp, Artificial Sequence
  Description of Artificial Sequence: Synthetic oligonucleotide
  Target: ANGPTL3; (+) strand; PAM type: YTN; PAM sequence: TTT
gtggcatcgagttaaagttt

SEQ ID NO: 16023 - DNA, 20 bp, Artificial Sequence
  Description of Artificial Sequence: Synthetic oligonucleotide
  Target: ANGPTL3; (+) strand; PAM type: YTN; PAM sequence: TTG
tggcatcgagttaaagttta

SEQ ID NO: 16024 - DNA, 20 bp, Artificial Sequence
  Description of Artificial Sequence: Synthetic oligonucleotide
  Target: ANGPTL3; (+) strand; PAM type: YTN; PAM sequence: TTA
aagtttatatttcccctaaa

SEQ ID NO: 16025 - DNA, 20 bp, Artificial Sequence
  Description of Artificial Sequence: Synthetic oligonucleotide
  Target: ANGPTL3; (+) strand; PAM type: YTN; PAM sequence: TTT
atatttcccctaaatatgct

SEQ ID NO: 16026 - DNA, 20 bp, Artificial Sequence
  Description of Artificial Sequence: Synthetic oligonucleotide
  Target: ANGPTL3; (+) strand; PAM type: YTN; PAM sequence: TTA
tatttcccctaaatatgctg

SEQ ID NO: 16027 - DNA, 20 bp, Artificial Sequence
  Description of Artificial Sequence: Synthetic oligonucleotide
  Target: ANGPTL3; (+) strand; PAM type: YTN; PAM sequence: TTT
cccctaaatatgctgtgatt

SEQ ID NO: 16028 - DNA, 20 bp, Artificial Sequence
  Description of Artificial Sequence: Synthetic oligonucleotide
  Target: ANGPTL3; (+) strand; PAM type: YTN; PAM sequence: TTC
ccctaaatatgctgtgattc

SEQ ID NO: 16029 - DNA, 20 bp, Artificial Sequence
  Description of Artificial Sequence: Synthetic oligonucleotide
  Target: ANGPTL3; (+) strand; PAM type: YTN; PAM sequence: CTA
aatatgctgtgattctaata

SEQ ID NO: 16030 - DNA, 20 bp, Artificial Sequence
  Description of Artificial Sequence: Synthetic oligonucleotide
  Target: ANGPTL3; (+) strand; PAM type: YTN; PAM sequence: CTG
tgattctaatacattcgtgt

SEQ ID NO: 16031 - DNA, 20 bp, Artificial Sequence
  Description of Artificial Sequence: Synthetic oligonucleotide
  Target: ANGPTL3; (+) strand; PAM type: YTN; PAM sequence: TTC
taatacattcgtgtaggttt

SEQ ID NO: 16032 - DNA, 20 bp, Artificial Sequence
  Description of Artificial Sequence: Synthetic oligonucleotide
  Target: ANGPTL3; (+) strand; PAM type: YTN; PAM sequence: CTA
atacattcgtgtaggttttc

SEQ ID NO: 16033 - DNA, 20 bp, Artificial Sequence
  Description of Artificial Sequence: Synthetic oligonucleotide
  Target: ANGPTL3; (+) strand; PAM type: YTN; PAM sequence: TTC
gtgtaggttttcaagtagaa

SEQ ID NO: 16034 - DNA, 20 bp, Artificial Sequence
  Description of Artificial Sequence: Synthetic oligonucleotide
  Target: ANGPTL3; (+) strand; PAM type: YTN; PAM sequence: TTT
tcaagtagaaataaacctcg

SEQ ID NO: 16035 - DNA, 20 bp, Artificial Sequence
  Description of Artificial Sequence: Synthetic oligonucleotide
  Target: ANGPTL3; (+) strand; PAM type: YTN; PAM sequence: TTT
caagtagaaataaacctcgt

SEQ ID NO: 16036 - DNA, 20 bp, Artificial Sequence
  Description of Artificial Sequence: Synthetic oligonucleotide
  Target: ANGPTL3; (+) strand; PAM type: YTN; PAM sequence: TTC
aagtagaaataaacctcgta

SEQ ID NO: 16037 - DNA, 20 bp, Artificial Sequence
  Description of Artificial Sequence: Synthetic oligonucleotide
  Target: ANGPTL3; (+) strand; PAM type: YTN; PAM sequence: CTC
gtaacaagttactgaacgtt

SEQ ID NO: 16038 - DNA, 20 bp, Artificial Sequence
  Description of Artificial Sequence: Synthetic oligonucleotide
  Target: ANGPTL3; (+) strand; PAM type: YTN; PAM sequence: TTA
ctgaacgtttaaacagcctg

SEQ ID NO: 16039 - DNA, 20 bp, Artificial Sequence
  Description of Artificial Sequence: Synthetic oligonucleotide
  Target: ANGPTL3; (+) strand; PAM type: YTN; PAM sequence: CTG
aacgtttaaacagcctgaca

SEQ ID NO: 16040 - DNA, 20 bp, Artificial Sequence
  Description of Artificial Sequence: Synthetic oligonucleotide
  Target: ANGPTL3; (+) strand; PAM type: YTN; PAM sequence: TTT
aaacagcctgacaagcatgt

SEQ ID NO: 16041 - DNA, 20 bp, Artificial Sequence
  Description of Artificial Sequence: Synthetic oligonucleotide
  Target: ANGPTL3; (+) strand; PAM type: YTN; PAM sequence: TTA
aacagcctgacaagcatgta

SEQ ID NO: 16042 - DNA, 20 bp, Artificial Sequence
  Description of Artificial Sequence: Synthetic oligonucleotide
  Target: ANGPTL3; (+) strand; PAM type: YTN; PAM sequence: CTG
acaagcatgtatatatgttt

SEQ ID NO: 16043 - DNA, 20 bp, Artificial Sequence
  Description of Artificial Sequence: Synthetic oligonucleotide
  Target: ANGPTL3; (+) strand; PAM type: YTN; PAM sequence: TTT
aaaattcaataaacaaagac

SEQ ID NO: 16044 - DNA, 20 bp, Artificial Sequence
  Description of Artificial Sequence: Synthetic oligonucleotide
  Target: ANGPTL3; (+) strand; PAM type: YTN; PAM sequence: TTA
aaattcaataaacaaagacc

SEQ ID NO: 16045 - DNA, 20 bp, Artificial Sequence
  Description of Artificial Sequence: Synthetic oligonucleotide
  Target: ANGPTL3; (+) strand; PAM type: YTN; PAM sequence: TTC
aataaacaaagacccagtcc

SEQ ID NO: 16046 - DNA, 20 bp, Artificial Sequence
  Description of Artificial Sequence: Synthetic oligonucleotide
  Target: ANGPTL3; (+) strand; PAM type: YTN; PAM sequence: CTA
aattatagaaatttaaatta

SEQ ID NO: 16047 - DNA, 20 bp, Artificial Sequence
  Description of Artificial Sequence: Synthetic oligonucleotide
  Target: ANGPTL3; (+) strand; PAM type: YTN; PAM sequence: TTA
tagaaatttaaattattctt

SEQ ID NO: 16048 - DNA, 20 bp, Artificial Sequence
  Description of Artificial Sequence: Synthetic oligonucleotide
  Target: ANGPTL3; (+) strand; PAM type: YTN; PAM sequence: TTT
aaattattcttgcatgttta

SEQ ID NO: 16049 - DNA, 20 bp, Artificial Sequence
  Description of Artificial Sequence: Synthetic oligonucleotide
  Target: ANGPTL3; (+) strand; PAM type: YTN; PAM sequence: TTA
aattattcttgcatgtttat

SEQ ID NO: 16050 - DNA, 20 bp, Artificial Sequence
  Description of Artificial Sequence: Synthetic oligonucleotide
  Target: ANGPTL3; (+) strand; PAM type: YTN; PAM sequence: TTA
ttcttgcatgtttatcgaca

SEQ ID NO: 16051 - DNA, 20 bp, Artificial Sequence
  Description of Artificial Sequence: Synthetic oligonucleotide
  Target: ANGPTL3; (+) strand; PAM type: YTN; PAM sequence: TTC
ttgcatgtttatcgacatca

SEQ ID NO: 16052 - DNA, 20 bp, Artificial Sequence
  Description of Artificial Sequence: Synthetic oligonucleotide
  Target: ANGPTL3; (+) strand; PAM type: YTN; PAM sequence: CTT
gcatgtttatcgacatcaca

SEQ ID NO: 16053 - DNA, 20 bp, Artificial Sequence
  Description of Artificial Sequence: Synthetic oligonucleotide
  Target: ANGPTL3; (+) strand; PAM type: YTN; PAM sequence: TTG
catgtttatcgacatcacaa

SEQ ID NO: 16054 - DNA, 20 bp, Artificial Sequence
  Description of Artificial Sequence: Synthetic oligonucleotide
  Target: ANGPTL3; (+) strand; PAM type: YTN; PAM sequence: TTT
atcgacatcacaacagatcc

SEQ ID NO: 16055 - DNA, 20 bp, Artificial Sequence
  Description of Artificial Sequence: Synthetic oligonucleotide
  Target: ANGPTL3; (+) strand; PAM type: YTN; PAM sequence: TTA
tcgacatcacaacagatccc

SEQ ID NO: 16056 - DNA, 20 bp, Artificial Sequence
  Description of Artificial Sequence: Synthetic oligonucleotide
  Target: ANGPTL3; (+) strand; PAM type: YTN; PAM sequence: CTA
aatccctaaatccctaaaga

SEQ ID NO: 16057 - DNA, 20 bp, Artificial Sequence
  Description of Artificial Sequence: Synthetic oligonucleotide
  Target: ANGPTL3; (+) strand; PAM type: YTN; PAM sequence: CTA
aatccctaaagattagatac

SEQ ID NO: 16058 - DNA, 20 bp, Artificial Sequence
  Description of Artificial Sequence: Synthetic oligonucleotide
  Target: ANGPTL3; (+) strand; PAM type: YTN; PAM sequence: CTA
aagattagatacaaattttt

SEQ ID NO: 16059 - DNA, 20 bp, Artificial Sequence
  Description of Artificial Sequence: Synthetic oligonucleotide
  Target: ANGPTL3; (+) strand; PAM type: YTN; PAM sequence: TTA
gatacaaattttttaccaca

SEQ ID NO: 16060 - DNA, 20 bp, Artificial Sequence
  Description of Artificial Sequence: Synthetic oligonucleotide
  Target: ANGPTL3; (+) strand; PAM type: YTN; PAM sequence: TTT
tttaccacagtatcacttgt

SEQ ID NO: 16061 - DNA, 20 bp, Artificial Sequence
  Description of Artificial Sequence: Synthetic oligonucleotide
  Target: ANGPTL3; (+) strand; PAM type: YTN; PAM sequence: TTT
ttaccacagtatcacttgtc

SEQ ID NO: 16062 - DNA, 20 bp, Artificial Sequence
  Description of Artificial Sequence: Synthetic oligonucleotide
  Target: ANGPTL3; (+) strand; PAM type: YTN; PAM sequence: TTT
taccacagtatcacttgtca

SEQ ID NO: 16063 - DNA, 20 bp, Artificial Sequence
  Description of Artificial Sequence: Synthetic oligonucleotide
  Target: ANGPTL3; (+) strand; PAM type: YTN; PAM sequence: TTT
accacagtatcacttgtcag

SEQ ID NO: 16064 - DNA, 20 bp, Artificial Sequence
  Description of Artificial Sequence: Synthetic oligonucleotide
  Target: ANGPTL3; (+) strand; PAM type: YTN; PAM sequence: TTA
ccacagtatcacttgtcaga

SEQ ID NO: 16065 - DNA, 20 bp, Artificial Sequence
  Description of Artificial Sequence: Synthetic oligonucleotide
  Target: ANGPTL3; (+) strand; PAM type: YTN; PAM sequence: CTT
gtcagaatttatttttaaat

SEQ ID NO: 16066 - DNA, 20 bp, Artificial Sequence
  Description of Artificial Sequence: Synthetic oligonucleotide
  Target: ANGPTL3; (+) strand; PAM type: YTN; PAM sequence: TTG
tcagaatttatttttaaata

SEQ ID NO: 16067 - DNA, 20 bp, Artificial Sequence
  Description of Artificial Sequence: Synthetic oligonucleotide
  Target: ANGPTL3; (+) strand; PAM type: YTN; PAM sequence: TTT
atttttaaatatgatttttt

SEQ ID NO: 16068 - DNA, 20 bp, Artificial Sequence
  Description of Artificial Sequence: Synthetic oligonucleotide
  Target: ANGPTL3; (+) strand; PAM type: YTN; PAM sequence: TTA
tttttaaatatgatttttta

SEQ ID NO: 16069 - DNA, 20 bp, Artificial Sequence
  Description of Artificial Sequence: Synthetic oligonucleotide
  Target: ANGPTL3; (+) strand; PAM type: YTN; PAM sequence: TTT
ttaaatatgattttttaaaa

SEQ ID NO: 16070 - DNA, 20 bp, Artificial Sequence
  Description of Artificial Sequence: Synthetic oligonucleotide
  Target: ANGPTL3; (+) strand; PAM type: YTN; PAM sequence: TTT
taaatatgattttttaaaac

SEQ ID NO: 16071 - DNA, 20 bp, Artificial Sequence
  Description of Artificial Sequence: Synthetic oligonucleotide
  Target: ANGPTL3; (+) strand; PAM type: YTN; PAM sequence: TTT
aaatatgattttttaaaact

SEQ ID NO: 16072 - DNA, 20 bp, Artificial Sequence
  Description of Artificial Sequence: Synthetic oligonucleotide
  Target: ANGPTL3; (+) strand; PAM type: YTN; PAM sequence: TTA
aatatgattttttaaaactg

SEQ ID NO: 16073 - DNA, 20 bp, Artificial Sequence
  Description of Artificial Sequence: Synthetic oligonucleotide
  Target: ANGPTL3; (+) strand; PAM type: YTN; PAM sequence: TTT
tttaaaactgccagtaagaa

SEQ ID NO: 16074 - DNA, 20 bp, Artificial Sequence
  Description of Artificial Sequence: Synthetic oligonucleotide
  Target: ANGPTL3; (+) strand; PAM type: YTN; PAM sequence: TTT
ttaaaactgccagtaagaaa

SEQ ID NO: 16075 - DNA, 20 bp, Artificial Sequence
  Description of Artificial Sequence: Synthetic oligonucleotide
  Target: ANGPTL3; (+) strand; PAM type: YTN; PAM sequence: TTT
taaaactgccagtaagaaat

SEQ ID NO: 16076 - DNA, 20 bp, Artificial Sequence
  Description of Artificial Sequence: Synthetic oligonucleotide
  Target: ANGPTL3; (+) strand; PAM type: YTN; PAM sequence: TTT
aaaactgccagtaagaaatt

SEQ ID NO: 16077 - DNA, 20 bp, Artificial Sequence
  Description of Artificial Sequence: Synthetic oligonucleotide
  Target: ANGPTL3; (+) strand; PAM type: YTN; PAM sequence: TTA
aaactgccagtaagaaattt

SEQ ID NO: 16078 - DNA, 20 bp, Artificial Sequence
  Description of Artificial Sequence: Synthetic oligonucleotide
  Target: ANGPTL3; (+) strand; PAM type: YTN; PAM sequence: CTG
ccagtaagaaattttaaatt

SEQ ID NO: 16079 - DNA, 20 bp, Artificial Sequence
  Description of Artificial Sequence: Synthetic oligonucleotide
  Target: ANGPTL3; (+) strand; PAM type: YTN; PAM sequence: TTT
taaattaaacccatttgtta

SEQ ID NO: 16080 - DNA, 20 bp, Artificial Sequence
  Description of Artificial Sequence: Synthetic oligonucleotide
  Target: ANGPTL3; (+) strand; PAM type: YTN; PAM sequence: TTT
aaattaaacccatttgttaa

SEQ ID NO: 16081 - DNA, 20 bp, Artificial Sequence
  Description of Artificial Sequence: Synthetic oligonucleotide
  Target: ANGPTL3; (+) strand; PAM type: YTN; PAM sequence: TTA
aattaaacccatttgttaaa

SEQ ID NO: 16082 - DNA, 20 bp, Artificial Sequence
  Description of Artificial Sequence: Synthetic oligonucleotide
  Target: ANGPTL3; (+) strand; PAM type: YTN; PAM sequence: TTA
aacccatttgttaaaggata

SEQ ID NO: 16083 - DNA, 20 bp, Artificial Sequence
  Description of Artificial Sequence: Synthetic oligonucleotide
  Target: ANGPTL3; (+) strand; PAM type: YTN; PAM sequence: TTT
gttaaaggatatagtgccca

SEQ ID NO: 16084 - DNA, 20 bp, Artificial Sequence
  Description of Artificial Sequence: Synthetic oligonucleotide
  Target: ANGPTL3; (+) strand; PAM type: YTN; PAM sequence: TTG
ttaaaggatatagtgcccaa

SEQ ID NO: 16085 - DNA, 20 bp, Artificial Sequence
  Description of Artificial Sequence: Synthetic oligonucleotide
  Target: ANGPTL3; (+) strand; PAM type: YTN; PAM sequence: TTA
aaggatatagtgcccaagtt

SEQ ID NO: 16086 - DNA, 20 bp, Artificial Sequence
  Description of Artificial Sequence: Synthetic oligonucleotide
  Target: ANGPTL3; (+) strand; PAM type: YTN; PAM sequence: TTA
tatggtgacctacctttgtc

SEQ ID NO: 16087 - DNA, 20 bp, Artificial Sequence
  Description of Artificial Sequence: Synthetic oligonucleotide
  Target: ANGPTL3; (+) strand; PAM type: YTN; PAM sequence: CTA
cctttgtcaatacttagcat

SEQ ID NO: 16088 - DNA, 20 bp, Artificial Sequence
  Description of Artificial Sequence: Synthetic oligonucleotide
  Target: ANGPTL3; (+) strand; PAM type: YTN; PAM sequence: CTT
tgtcaatacttagcattatg

SEQ ID NO: 16089 - DNA, 20 bp, Artificial Sequence
  Description of Artificial Sequence: Synthetic oligonucleotide
  Target: ANGPTL3; (+) strand; PAM type: YTN; PAM sequence: TTT
gtcaatacttagcattatgt

SEQ ID NO: 16090 - DNA, 20 bp, Artificial Sequence
  Description of Artificial Sequence: Synthetic oligonucleotide
  Target: ANGPTL3; (+) strand; PAM type: YTN; PAM sequence: TTG
tcaatacttagcattatgta

SEQ ID NO: 16091 - DNA, 20 bp, Artificial Sequence
  Description of Artificial Sequence: Synthetic oligonucleotide
  Target: ANGPTL3; (+) strand; PAM type: YTN; PAM sequence: CTT
agcattatgtatttcaaatt

SEQ ID NO: 16092 - DNA, 20 bp, Artificial Sequence
  Description of Artificial Sequence: Synthetic oligonucleotide
  Target: ANGPTL3; (+) strand; PAM type: YTN; PAM sequence: TTA
gcattatgtatttcaaatta

SEQ ID NO: 16093 - DNA, 20 bp, Artificial Sequence
  Description of Artificial Sequence: Synthetic oligonucleotide
  Target: ANGPTL3; (+) strand; PAM type: YTN; PAM sequence: TTA
tgtatttcaaattatccaat

SEQ ID NO: 16094 - DNA, 20 bp, Artificial Sequence
  Description of Artificial Sequence: Synthetic oligonucleotide
  Target: ANGPTL3; (+) strand; PAM type: YTN; PAM sequence: TTT
caaattatccaatatacatg

SEQ ID NO: 16095 - DNA, 20 bp, Artificial Sequence
  Description of Artificial Sequence: Synthetic oligonucleotide
  Target: ANGPTL3; (+) strand; PAM type: YTN; PAM sequence: TTC
aaattatccaatatacatgt

SEQ ID NO: 16096 - DNA, 20 bp, Artificial Sequence
  Description of Artificial Sequence: Synthetic oligonucleotide
  Target: ANGPTL3; (+) strand; PAM type: YTN; PAM sequence: TTA
tccaatatacatgtcatata

SEQ ID NO: 16097 - DNA, 20 bp, Artificial Sequence
  Description of Artificial Sequence: Synthetic oligonucleotide
  Target: ANGPTL3; (+) strand; PAM type: YTN; PAM sequence: TTT
ttatatgtcacatatataaa

SEQ ID NO: 16098 - DNA, 20 bp, Artificial Sequence
  Description of Artificial Sequence: Synthetic oligonucleotide
  Target: ANGPTL3; (+) strand; PAM type: YTN; PAM sequence: TTT
tatatgtcacatatataaaa

SEQ ID NO: 16099 - DNA, 20 bp, Artificial Sequence
  Description of Artificial Sequence: Synthetic oligonucleotide
  Target: ANGPTL3; (+) strand; PAM type: YTN; PAM sequence: TTT
atatgtcacatatataaaag

SEQ ID NO: 16100 - DNA, 20 bp, Artificial Sequence
  Description of Artificial Sequence: Synthetic oligonucleotide
  Target: ANGPTL3; (+) strand; PAM type: YTN; PAM sequence: TTA
tatgtcacatatataaaaga

SEQ ID NO: 16101 - DNA, 20 bp, Artificial Sequence
  Description of Artificial Sequence: Synthetic oligonucleotide
  Target: ANGPTL3; (+) strand; PAM type: YTN; PAM sequence: CTA
tgtgaatcctaagtaaatat

SEQ ID NO: 16102 - DNA, 20 bp, Artificial Sequence
  Description of Artificial Sequence: Synthetic oligonucleotide
  Target: ANGPTL3; (+) strand; PAM type: YTN; PAM sequence: CTA
agtaaatattttgttccaga

SEQ ID NO: 16103 - DNA, 20 bp, Artificial Sequence
  Description of Artificial Sequence: Synthetic oligonucleotide
  Target: ANGPTL3; (+) strand; PAM type: YTN; PAM sequence: TTT
tgttccagaaaagtacaaaa

SEQ ID NO: 16104 - DNA, 20 bp, Artificial Sequence
  Description of Artificial Sequence: Synthetic oligonucleotide
  Target: ANGPTL3; (+) strand; PAM type: YTN; PAM sequence: TTT
gttccagaaaagtacaaaat

SEQ ID NO: 16105 - DNA, 20 bp, Artificial Sequence
  Description of Artificial Sequence: Synthetic oligonucleotide
  Target: ANGPTL3; (+) strand; PAM type: YTN; PAM sequence: TTG
ttccagaaaagtacaaaata

SEQ ID NO: 16106 - DNA, 20 bp, Artificial Sequence
  Description of Artificial Sequence: Synthetic oligonucleotide
  Target: ANGPTL3; (+) strand; PAM type: YTN; PAM sequence: TTC
cagaaaagtacaaaataata

SEQ ID NO: 16107 - DNA, 20 bp, Artificial Sequence
  Description of Artificial Sequence: Synthetic oligonucleotide
  Target: ANGPTL3; (+) strand; PAM type: YTN; PAM sequence: CTA
taattttcaggaccacagac

SEQ ID NO: 16108 - DNA, 20 bp, Artificial Sequence
  Description of Artificial Sequence: Synthetic oligonucleotide
  Target: ANGPTL3; (+) strand; PAM type: YTN; PAM sequence: TTT
tcaggaccacagactaagct

SEQ ID NO: 16109 - DNA, 20 bp, Artificial Sequence
  Description of Artificial Sequence: Synthetic oligonucleotide
  Target: ANGPTL3; (+) strand; PAM type: YTN; PAM sequence: TTT
caggaccacagactaagctg

SEQ ID NO: 16110 - DNA, 20 bp, Artificial Sequence
  Description of Artificial Sequence: Synthetic oligonucleotide
  Target: ANGPTL3; (+) strand; PAM type: YTN; PAM sequence: TTC
aggaccacagactaagctgt

SEQ ID NO: 16111 - DNA, 20 bp, Artificial Sequence
  Description of Artificial Sequence: Synthetic oligonucleotide
  Target: ANGPTL3; (+) strand; PAM type: YTN; PAM sequence: CTA
agctgtcgaaattaacgctg

SEQ ID NO: 16112 - DNA, 20 bp, Artificial Sequence
  Description of Artificial Sequence: Synthetic oligonucleotide
  Target: ANGPTL3; (+) strand; PAM type: YTN; PAM sequence: CTG
tcgaaattaacgctgatttt

SEQ ID NO: 16113 - DNA, 20 bp, Artificial Sequence
  Description of Artificial Sequence: Synthetic oligonucleotide
  Target: ANGPTL3; (+) strand; PAM type: YTN; PAM sequence: TTA
acgctgatttttttagggcc

SEQ ID NO: 16114 - DNA, 20 bp, Artificial Sequence
  Description of Artificial Sequence: Synthetic oligonucleotide
  Target: ANGPTL3; (+) strand; PAM type: YTN; PAM sequence: CTG
atttttttagggccagaata

SEQ ID NO: 16115 - DNA, 20 bp, Artificial Sequence
  Description of Artificial Sequence: Synthetic oligonucleotide
  Target: ANGPTL3; (+) strand; PAM type: YTN; PAM sequence: TTT
ttttagggccagaataccaa

SEQ ID NO: 16116 - DNA, 20 bp, Artificial Sequence
  Description of Artificial Sequence: Synthetic oligonucleotide
  Target: ANGPTL3; (+) strand; PAM type: YTN; PAM sequence: TTT
tttagggccagaataccaaa

SEQ ID NO: 16117 - DNA, 20 bp, Artificial Sequence
  Description of Artificial Sequence: Synthetic oligonucleotide
  Target: ANGPTL3; (+) strand; PAM type: YTN; PAM sequence: TTT
ttagggccagaataccaaaa

SEQ ID NO: 16118 - DNA, 20 bp, Artificial Sequence
  Description of Artificial Sequence: Synthetic oligonucleotide
  Target: ANGPTL3; (+) strand; PAM type: YTN; PAM sequence: TTT
tagggccagaataccaaaat

SEQ ID NO: 16119 - DNA, 20 bp, Artificial Sequence
  Description of Artificial Sequence: Synthetic oligonucleotide
  Target: ANGPTL3; (+) strand; PAM type: YTN; PAM sequence: TTT
agggccagaataccaaaatg

SEQ ID NO: 16120 - DNA, 20 bp, Artificial Sequence
  Description of Artificial Sequence: Synthetic oligonucleotide
  Target: ANGPTL3; (+) strand; PAM type: YTN; PAM sequence: TTA
gggccagaataccaaaatgg

SEQ ID NO: 16121 - DNA, 20 bp, Artificial Sequence
  Description of Artificial Sequence: Synthetic oligonucleotide
  Target: ANGPTL3; (+) strand; PAM type: YTN; PAM sequence: CTC
ctctcttcccccaaaattgg

SEQ ID NO: 16122 - DNA, 20 bp, Artificial Sequence
  Description of Artificial Sequence: Synthetic oligonucleotide
  Target: ANGPTL3; (+) strand; PAM type: YTN; PAM sequence: CTC
tcttcccccaaaattggaca

SEQ ID NO: 16123 - DNA, 20 bp, Artificial Sequence
  Description of Artificial Sequence: Synthetic oligonucleotide
  Target: ANGPTL3; (+) strand; PAM type: YTN; PAM sequence: CTC
ttcccccaaaattggacaat

SEQ ID NO: 16124 - DNA, 20 bp, Artificial Sequence
  Description of Artificial Sequence: Synthetic oligonucleotide
  Target: ANGPTL3; (+) strand; PAM type: YTN; PAM sequence: CTT
cccccaaaattggacaattt

SEQ ID NO: 16125 - DNA, 20 bp, Artificial Sequence
  Description of Artificial Sequence: Synthetic oligonucleotide
  Target: ANGPTL3; (+) strand; PAM type: YTN; PAM sequence: TTC
ccccaaaattggacaatttc

SEQ ID NO: 16126 - DNA, 20 bp, Artificial Sequence
  Description of Artificial Sequence: Synthetic oligonucleotide
  Target: ANGPTL3; (+) strand; PAM type: YTN; PAM sequence: TTG
gacaatttcaaatgcaaaat

SEQ ID NO: 16127 - DNA, 20 bp, Artificial Sequence
  Description of Artificial Sequence: Synthetic oligonucleotide
  Target: ANGPTL3; (+) strand; PAM type: YTN; PAM sequence: TTT
caaatgcaaaataattcatt

SEQ ID NO: 16128 - DNA, 20 bp, Artificial Sequence
  Description of Artificial Sequence: Synthetic oligonucleotide
  Target: ANGPTL3; (+) strand; PAM type: YTN; PAM sequence: TTC
aaatgcaaaataattcatta

SEQ ID NO: 16129 - DNA, 20 bp, Artificial Sequence
  Description of Artificial Sequence: Synthetic oligonucleotide
  Target: ANGPTL3; (+) strand; PAM type: YTN; PAM sequence: TTC
attatttaatatatgagttg

SEQ ID NO: 16130 - DNA, 20 bp, Artificial Sequence
  Description of Artificial Sequence: Synthetic oligonucleotide
  Target: ANGPTL3; (+) strand; PAM type: YTN; PAM sequence: TTA
tttaatatatgagttgcttc

SEQ ID NO: 16131 - DNA, 20 bp, Artificial Sequence
  Description of Artificial Sequence: Synthetic oligonucleotide
  Target: ANGPTL3; (+) strand; PAM type: YTN; PAM sequence: TTT
aatatatgagttgcttcctc

SEQ ID NO: 16132 - DNA, 20 bp, Artificial Sequence
  Description of Artificial Sequence: Synthetic oligonucleotide
  Target: ANGPTL3; (+) strand; PAM type: YTN; PAM sequence: TTA
atatatgagttgcttcctct

SEQ ID NO: 16133 - DNA, 20 bp, Artificial Sequence
  Description of Artificial Sequence: Synthetic oligonucleotide
  Target: ANGPTL3; (+) strand; PAM type: YTN; PAM sequence: TTG
cttcctctatttggtttcct

SEQ ID NO: 16134 - DNA, 20 bp, Artificial Sequence
  Description of Artificial Sequence: Synthetic oligonucleotide
  Target: ANGPTL3; (+) strand; PAM type: YTN; PAM sequence: CTT
cctctatttggtttccttaa

SEQ ID NO: 16135 - DNA, 20 bp, Artificial Sequence
  Description of Artificial Sequence: Synthetic oligonucleotide
  Target: ANGPTL3; (+) strand; PAM type: YTN; PAM sequence: TTC
ctctatttggtttccttaaa

SEQ ID NO: 16136 - DNA, 20 bp, Artificial Sequence
  Description of Artificial Sequence: Synthetic oligonucleotide
  Target: ANGPTL3; (+) strand; PAM type: YTN; PAM sequence: CTC
tatttggtttccttaaaaaa

SEQ ID NO: 16137 - DNA, 20 bp, Artificial Sequence
  Description of Artificial Sequence: Synthetic oligonucleotide
  Target: ANGPTL3; (+) strand; PAM type: YTN; PAM sequence: CTA
tttggtttccttaaaaaaaa

SEQ ID NO: 16138 - DNA, 20 bp, Artificial Sequence
  Description of Artificial Sequence: Synthetic oligonucleotide
  Target: ANGPTL3; (+) strand; PAM type: YTN; PAM sequence: TTT
ggtttccttaaaaaaaaaaa

SEQ ID NO: 16139 - DNA, 20 bp, Artificial Sequence
  Description of Artificial Sequence: Synthetic oligonucleotide
  Target: ANGPTL3; (+) strand; PAM type: YTN; PAM sequence: TTG
gtttccttaaaaaaaaaaaa

SEQ ID NO: 16140 - DNA, 20 bp, Artificial Sequence
  Description of Artificial Sequence: Synthetic oligonucleotide
  Target: ANGPTL3; (+) strand; PAM type: YTN; PAM sequence: TTT
ccttaaaaaaaaaaaaaact

SEQ ID NO: 16141 - DNA, 20 bp, Artificial Sequence
  Description of Artificial Sequence: Synthetic oligonucleotide
  Target: ANGPTL3; (+) strand; PAM type: YTN; PAM sequence: TTC
cttaaaaaaaaaaaaaactc

SEQ ID NO: 16142 - DNA, 20 bp, Artificial Sequence
  Description of Artificial Sequence: Synthetic oligonucleotide
  Target: ANGPTL3; (+) strand; PAM type: YTN; PAM sequence: CTT
aaaaaaaaaaaaaactctca

SEQ ID NO: 16143 - DNA, 20 bp, Artificial Sequence
  Description of Artificial Sequence: Synthetic oligonucleotide
  Target: ANGPTL3; (+) strand; PAM type: YTN; PAM sequence: TTA
aaaaaaaaaaaaactctcat

SEQ ID NO: 16144 - DNA, 20 bp, Artificial Sequence
  Description of Artificial Sequence: Synthetic oligonucleotide
  Target: ANGPTL3; (+) strand; PAM type: YTN; PAM sequence: CTC
tcataggacatgtttcattt

SEQ ID NO: 16145 - DNA, 20 bp, Artificial Sequence
  Description of Artificial Sequence: Synthetic oligonucleotide
  Target: ANGPTL3; (+) strand; PAM type: YTN; PAM sequence: CTC
ataggacatgtttcattttg

SEQ ID NO: 16146 - DNA, 20 bp, Artificial Sequence
  Description of Artificial Sequence: Synthetic oligonucleotide
  Target: ANGPTL3; (+) strand; PAM type: YTN; PAM sequence: TTT
cattttgttcctttcaggag

SEQ ID NO: 16147 - DNA, 20 bp, Artificial Sequence
  Description of Artificial Sequence: Synthetic oligonucleotide
  Target: ANGPTL3; (+) strand; PAM type: YTN; PAM sequence: TTC
attttgttcctttcaggagt

SEQ ID NO: 16148 - DNA, 20 bp, Artificial Sequence
  Description of Artificial Sequence: Synthetic oligonucleotide
  Target: ANGPTL3; (+) strand; PAM type: YTN; PAM sequence: TTT
tgttcctttcaggagtagta

SEQ ID NO: 16149 - DNA, 20 bp, Artificial Sequence
  Description of Artificial Sequence: Synthetic oligonucleotide
  Target: ANGPTL3; (+) strand; PAM type: YTN; PAM sequence: TTT
gttcctttcaggagtagtaa

SEQ ID NO: 16150 - DNA, 20 bp, Artificial Sequence
  Description of Artificial Sequence: Synthetic oligonucleotide
  Target: ANGPTL3; (+) strand; PAM type: YTN; PAM sequence: TTG
ttcctttcaggagtagtaaa

SEQ ID NO: 16151 - DNA, 20 bp, Artificial Sequence
  Description of Artificial Sequence: Synthetic oligonucleotide
  Target: ANGPTL3; (+) strand; PAM type: YTN; PAM sequence: TTC
ctttcaggagtagtaaatta

SEQ ID NO: 16152 - DNA, 20 bp, Artificial Sequence
  Description of Artificial Sequence: Synthetic oligonucleotide
  Target: ANGPTL3; (+) strand; PAM type: YTN; PAM sequence: CTT
tcaggagtagtaaattagac

SEQ ID NO: 16153 - DNA, 20 bp, Artificial Sequence
  Description of Artificial Sequence: Synthetic oligonucleotide
  Target: ANGPTL3; (+) strand; PAM type: YTN; PAM sequence: TTT
caggagtagtaaattagacg

SEQ ID NO: 16154 - DNA, 20 bp, Artificial Sequence
  Description of Artificial Sequence: Synthetic oligonucleotide
  Target: ANGPTL3; (+) strand; PAM type: YTN; PAM sequence: TTC
aggagtagtaaattagacgt

SEQ ID NO: 16155 - DNA, 20 bp, Artificial Sequence
  Description of Artificial Sequence: Synthetic oligonucleotide
  Target: ANGPTL3; (+) strand; PAM type: YTN; PAM sequence: TTA
gacgttttccccatataaag

SEQ ID NO: 16156 - DNA, 20 bp, Artificial Sequence
  Description of Artificial Sequence: Synthetic oligonucleotide
  Target: ANGPTL3; (+) strand; PAM type: YTN; PAM sequence: TTT
tccccatataaagctttttt

SEQ ID NO: 16157 - DNA, 20 bp, Artificial Sequence
  Description of Artificial Sequence: Synthetic oligonucleotide
  Target: ANGPTL3; (+) strand; PAM type: YTN; PAM sequence: TTT
ccccatataaagcttttttc

SEQ ID NO: 16158 - DNA, 20 bp, Artificial Sequence
  Description of Artificial Sequence: Synthetic oligonucleotide
  Target: ANGPTL3; (+) strand; PAM type: YTN; PAM sequence: TTC
cccatataaagcttttttct

SEQ ID NO: 16159 - DNA, 20 bp, Artificial Sequence
  Description of Artificial Sequence: Synthetic oligonucleotide
  Target: ANGPTL3; (+) strand; PAM type: YTN; PAM sequence: CTT
ttttctaccagaaagatact

SEQ ID NO: 16160 - DNA, 20 bp, Artificial Sequence
  Description of Artificial Sequence: Synthetic oligonucleotide
  Target: ANGPTL3; (+) strand; PAM type: YTN; PAM sequence: TTT
tttctaccagaaagatactt

SEQ ID NO: 16161 - DNA, 20 bp, Artificial Sequence
  Description of Artificial Sequence: Synthetic oligonucleotide
  Target: ANGPTL3; (+) strand; PAM type: YTN; PAM sequence: TTT
ttctaccagaaagatacttc

SEQ ID NO: 16162 - DNA, 20 bp, Artificial Sequence
  Description of Artificial Sequence: Synthetic oligonucleotide
  Target: ANGPTL3; (+) strand; PAM type: YTN; PAM sequence: TTT
tctaccagaaagatacttct

SEQ ID NO: 16163 - DNA, 20 bp, Artificial Sequence
  Description of Artificial Sequence: Synthetic oligonucleotide
  Target: ANGPTL3; (+) strand; PAM type: YTN; PAM sequence: TTT
ctaccagaaagatacttctg

SEQ ID NO: 16164 - DNA, 20 bp, Artificial Sequence
  Description of Artificial Sequence: Synthetic oligonucleotide
  Target: ANGPTL3; (+) strand; PAM type: YTN; PAM sequence: TTC
taccagaaagatacttctgg

SEQ ID NO: 16165 - DNA, 20 bp, Artificial Sequence
  Description of Artificial Sequence: Synthetic oligonucleotide
  Target: ANGPTL3; (+) strand; PAM type: YTN; PAM sequence: CTA
ccagaaagatacttctggta

SEQ ID NO: 16166 - DNA, 20 bp, Artificial Sequence
  Description of Artificial Sequence: Synthetic oligonucleotide
  Target: ANGPTL3; (+) strand; PAM type: YTN; PAM sequence: CTT
ctggtagaagaagagaaagg

SEQ ID NO: 16167 - DNA, 20 bp, Artificial Sequence
  Description of Artificial Sequence: Synthetic oligonucleotide
  Target: ANGPTL3; (+) strand; PAM type: YTN; PAM sequence: TTC
tggtagaagaagagaaagga

SEQ ID NO: 16168 - DNA, 20 bp, Artificial Sequence
  Description of Artificial Sequence: Synthetic oligonucleotide
  Target: ANGPTL3; (+) strand; PAM type: YTN; PAM sequence: CTG
gtagaagaagagaaaggagc

SEQ ID NO: 16169 - DNA, 20 bp, Artificial Sequence
  Description of Artificial Sequence: Synthetic oligonucleotide
  Target: ANGPTL3; (+) strand; PAM type: YTN; PAM sequence: CTC
tttatggttcacacgactgt

SEQ ID NO: 16170 - DNA, 20 bp, Artificial Sequence
  Description of Artificial Sequence: Synthetic oligonucleotide
  Target: ANGPTL3; (+) strand; PAM type: YTN; PAM sequence: CTT
tatggttcacacgactgtct

SEQ ID NO: 16171 - DNA, 20 bp, Artificial Sequence
  Description of Artificial Sequence: Synthetic oligonucleotide
  Target: ANGPTL3; (+) strand; PAM type: YTN; PAM sequence: TTT
atggttcacacgactgtctc

SEQ ID NO: 16172 - DNA, 20 bp, Artificial Sequence
  Description of Artificial Sequence: Synthetic oligonucleotide
  Target: ANGPTL3; (+) strand; PAM type: YTN; PAM sequence: TTA
tggttcacacgactgtctcc

SEQ ID NO: 16173 - DNA, 20 bp, Artificial Sequence
  Description of Artificial Sequence: Synthetic oligonucleotide
  Target: ANGPTL3; (+) strand; PAM type: YTN; PAM sequence: TTC
acacgactgtctcctgtcct

SEQ ID NO: 16174 - DNA, 20 bp, Artificial Sequence
  Description of Artificial Sequence: Synthetic oligonucleotide
  Target: ANGPTL3; (+) strand; PAM type: YTN; PAM sequence: CTG
tctcctgtcctaactacttt

SEQ ID NO: 16175 - DNA, 20 bp, Artificial Sequence
  Description of Artificial Sequence: Synthetic oligonucleotide
  Target: ANGPTL3; (+) strand; PAM type: YTN; PAM sequence: CTC
ctgtcctaactactttgctt

SEQ ID NO: 16176 - DNA, 20 bp, Artificial Sequence
  Description of Artificial Sequence: Synthetic oligonucleotide
  Target: ANGPTL3; (+) strand; PAM type: YTN; PAM sequence: CTG
tcctaactactttgcttaaa

SEQ ID NO: 16177 - DNA, 20 bp, Artificial Sequence
  Description of Artificial Sequence: Synthetic oligonucleotide
  Target: ANGPTL3; (+) strand; PAM type: YTN; PAM sequence: CTA
actactttgcttaaagtgct

SEQ ID NO: 16178 - DNA, 20 bp, Artificial Sequence
  Description of Artificial Sequence: Synthetic oligonucleotide
  Target: ANGPTL3; (+) strand; PAM type: YTN; PAM sequence: CTA
ctttgcttaaagtgctcaaa

SEQ ID NO: 16179 - DNA, 20 bp, Artificial Sequence
  Description of Artificial Sequence: Synthetic oligonucleotide
  Target: ANGPTL3; (+) strand; PAM type: YTN; PAM sequence: CTT
tgcttaaagtgctcaaattc

SEQ ID NO: 16180 - DNA, 20 bp, Artificial Sequence
  Description of Artificial Sequence: Synthetic oligonucleotide
  Target: ANGPTL3; (+) strand; PAM type: YTN; PAM sequence: TTT
gcttaaagtgctcaaattcc

SEQ ID NO: 16181 - DNA, 20 bp, Artificial Sequence
  Description of Artificial Sequence: Synthetic oligonucleotide
  Target: ANGPTL3; (+) strand; PAM type: YTN; PAM sequence: TTG
cttaaagtgctcaaattcca

SEQ ID NO: 16182 - DNA, 20 bp, Artificial Sequence
  Description of Artificial Sequence: Synthetic oligonucleotide
  Target: ANGPTL3; (+) strand; PAM type: YTN; PAM sequence: CTT
aaagtgctcaaattccatca

SEQ ID NO: 16183 - DNA, 20 bp, Artificial Sequence
  Description of Artificial Sequence: Synthetic oligonucleotide
  Target: ANGPTL3; (+) strand; PAM type: YTN; PAM sequence: TTA
aagtgctcaaattccatcac

SEQ ID NO: 16184 - DNA, 20 bp, Artificial Sequence
  Description of Artificial Sequence: Synthetic oligonucleotide
  Target: ANGPTL3; (+) strand; PAM type: YTN; PAM sequence: CTC
aaattccatcactactcaca

SEQ ID NO: 16185 - DNA, 20 bp, Artificial Sequence
  Description of Artificial Sequence: Synthetic oligonucleotide
  Target: ANGPTL3; (+) strand; PAM type: YTN; PAM sequence: TTC
catcactactcacagttgtc

SEQ ID NO: 16186 - DNA, 20 bp, Artificial Sequence
  Description of Artificial Sequence: Synthetic oligonucleotide
  Target: ANGPTL3; (+) strand; PAM type: YTN; PAM sequence: CTA
ctcacagttgtctaatctaa

SEQ ID NO: 16187 - DNA, 20 bp, Artificial Sequence
  Description of Artificial Sequence: Synthetic oligonucleotide
  Target: ANGPTL3; (+) strand; PAM type: YTN; PAM sequence: CTC
acagttgtctaatctaagtc

SEQ ID NO: 16188 - DNA, 20 bp, Artificial Sequence
  Description of Artificial Sequence: Synthetic oligonucleotide
  Target: ANGPTL3; (+) strand; PAM type: YTN; PAM sequence: TTG
tctaatctaagtctaatccc

SEQ ID NO: 16189 - DNA, 20 bp, Artificial Sequence
  Description of Artificial Sequence: Synthetic oligonucleotide
  Target: ANGPTL3; (+) strand; PAM type: YTN; PAM sequence: CTA
atctaagtctaatccccttt

SEQ ID NO: 16190 - DNA, 20 bp, Artificial Sequence
  Description of Artificial Sequence: Synthetic oligonucleotide
  Target: ANGPTL3; (+) strand; PAM type: YTN; PAM sequence: CTA
agtctaatcccctttgatct

SEQ ID NO: 16191 - DNA, 20 bp, Artificial Sequence
  Description of Artificial Sequence: Synthetic oligonucleotide
  Target: ANGPTL3; (+) strand; PAM type: YTN; PAM sequence: CTA
atcccctttgatctctcaga

SEQ ID NO: 16192 - DNA, 20 bp, Artificial Sequence
  Description of Artificial Sequence: Synthetic oligonucleotide
  Target: ANGPTL3; (+) strand; PAM type: YTN; PAM sequence: CTT
tgatctctcagactaccttc

SEQ ID NO: 16193 - DNA, 20 bp, Artificial Sequence
  Description of Artificial Sequence: Synthetic oligonucleotide
  Target: ANGPTL3; (+) strand; PAM type: YTN; PAM sequence: TTT
gatctctcagactaccttcc

SEQ ID NO: 16194 - DNA, 20 bp, Artificial Sequence
  Description of Artificial Sequence: Synthetic oligonucleotide
  Target: ANGPTL3; (+) strand; PAM type: YTN; PAM sequence: TTG
atctctcagactaccttccc

SEQ ID NO: 16195 - DNA, 20 bp, Artificial Sequence
  Description of Artificial Sequence: Synthetic oligonucleotide
  Target: ANGPTL3; (+) strand; PAM type: YTN; PAM sequence: CTC
tcagactaccttccctttta

SEQ ID NO: 16196 - DNA, 20 bp, Artificial Sequence
  Description of Artificial Sequence: Synthetic oligonucleotide
  Target: ANGPTL3; (+) strand; PAM type: YTN; PAM sequence: CTC
agactaccttcccttttatc

SEQ ID NO: 16197 - DNA, 20 bp, Artificial Sequence
  Description of Artificial Sequence: Synthetic oligonucleotide
  Target: ANGPTL3; (+) strand; PAM type: YTN; PAM sequence: CTA
ccttcccttttatctctcta

SEQ ID NO: 16198 - DNA, 20 bp, Artificial Sequence
  Description of Artificial Sequence: Synthetic oligonucleotide
  Target: ANGPTL3; (+) strand; PAM type: YTN; PAM sequence: CTT
cccttttatctctctactac

SEQ ID NO: 16199 - DNA, 20 bp, Artificial Sequence
  Description of Artificial Sequence: Synthetic oligonucleotide
  Target: ANGPTL3; (+) strand; PAM type: YTN; PAM sequence: TTC
ccttttatctctctactact

SEQ ID NO: 16200 - DNA, 20 bp, Artificial Sequence
  Description of Artificial Sequence: Synthetic oligonucleotide
  Target: ANGPTL3; (+) strand; PAM type: YTN; PAM sequence: CTT
ttatctctctactacttaat

SEQ ID NO: 16201 - DNA, 20 bp, Artificial Sequence
  Description of Artificial Sequence: Synthetic oligonucleotide
  Target: ANGPTL3; (+) strand; PAM type: YTN; PAM sequence: TTT
tatctctctactacttaata

SEQ ID NO: 16202 - DNA, 20 bp, Artificial Sequence
  Description of Artificial Sequence: Synthetic oligonucleotide
  Target: ANGPTL3; (+) strand; PAM type: YTN; PAM sequence: TTT
atctctctactacttaataa

SEQ ID NO: 16203 - DNA, 20 bp, Artificial Sequence
  Description of Artificial Sequence: Synthetic oligonucleotide
  Target: ANGPTL3; (+) strand; PAM type: YTN; PAM sequence: TTA
tctctctactacttaataat

SEQ ID NO: 16204 - DNA, 20 bp, Artificial Sequence
  Description of Artificial Sequence: Synthetic oligonucleotide
  Target: ANGPTL3; (+) strand; PAM type: YTN; PAM sequence: CTC
tctactacttaataataaga

SEQ ID NO: 16205 - DNA, 20 bp, Artificial Sequence
  Description of Artificial Sequence: Synthetic oligonucleotide
  Target: ANGPTL3; (+) strand; PAM type: YTN; PAM sequence: CTC
tactacttaataataagaat

SEQ ID NO: 16206 - DNA, 20 bp, Artificial Sequence
  Description of Artificial Sequence: Synthetic oligonucleotide
  Target: ANGPTL3; (+) strand; PAM type: YTN; PAM sequence: CTA
ctacttaataataagaatat

SEQ ID NO: 16207 - DNA, 20 bp, Artificial Sequence
  Description of Artificial Sequence: Synthetic oligonucleotide
  Target: ANGPTL3; (+) strand; PAM type: YTN; PAM sequence: CTA
cttaataataagaatatctt

SEQ ID NO: 16208 - DNA, 20 bp, Artificial Sequence
  Description of Artificial Sequence: Synthetic oligonucleotide
  Target: ANGPTL3; (+) strand; PAM type: YTN; PAM sequence: CTT
aataataagaatatcttttt

SEQ ID NO: 16209 - DNA, 20 bp, Artificial Sequence
  Description of Artificial Sequence: Synthetic oligonucleotide
  Target: ANGPTL3; (+) strand; PAM type: YTN; PAM sequence: TTA
ataataagaatatctttttt

SEQ ID NO: 16210 - DNA, 20 bp, Artificial Sequence
  Description of Artificial Sequence: Synthetic oligonucleotide
  Target: ANGPTL3; (+) strand; PAM type: YTN; PAM sequence: CTT
tttttcaaacttgaccttca

SEQ ID NO: 16211 - DNA, 20 bp, Artificial Sequence
  Description of Artificial Sequence: Synthetic oligonucleotide
  Target: ANGPTL3; (+) strand; PAM type: YTN; PAM sequence: TTT
ttttcaaacttgaccttcat

SEQ ID NO: 16212 - DNA, 20 bp, Artificial Sequence
  Description of Artificial Sequence: Synthetic oligonucleotide
  Target: ANGPTL3; (+) strand; PAM type: YTN; PAM sequence: TTT
tttcaaacttgaccttcatt

SEQ ID NO: 16213 - DNA, 20 bp, Artificial Sequence
  Description of Artificial Sequence: Synthetic oligonucleotide
  Target: ANGPTL3; (+) strand; PAM type: YTN; PAM sequence: TTT
ttcaaacttgaccttcattt

SEQ ID NO: 16214 - DNA, 20 bp, Artificial Sequence
  Description of Artificial Sequence: Synthetic oligonucleotide
  Target: ANGPTL3; (+) strand; PAM type: YTN; PAM sequence: TTT
tcaaacttgaccttcatttt

SEQ ID NO: 16215 - DNA, 20 bp, Artificial Sequence
  Description of Artificial Sequence: Synthetic oligonucleotide
  Target: ANGPTL3; (+) strand; PAM type: YTN; PAM sequence: TTT
caaacttgaccttcattttg

SEQ ID NO: 16216 - DNA, 20 bp, Artificial Sequence
  Description of Artificial Sequence: Synthetic oligonucleotide
  Target: ANGPTL3; (+) strand; PAM type: YTN; PAM sequence: TTC
aaacttgaccttcattttgc

SEQ ID NO: 16217 - DNA, 20 bp, Artificial Sequence
  Description of Artificial Sequence: Synthetic oligonucleotide
  Target: ANGPTL3; (+) strand; PAM type: YTN; PAM sequence: CTT
gaccttcattttgctttcac

SEQ ID NO: 16218 - DNA, 20 bp, Artificial Sequence
  Description of Artificial Sequence: Synthetic oligonucleotide
  Target: ANGPTL3; (+) strand; PAM type: YTN; PAM sequence: TTG
accttcattttgctttcaca

SEQ ID NO: 16219 - DNA, 20 bp, Artificial Sequence
  Description of Artificial Sequence: Synthetic oligonucleotide
  Target: ANGPTL3; (+) strand; PAM type: YTN; PAM sequence: CTT
cattttgctttcacaatact

SEQ ID NO: 16220 - DNA, 20 bp, Artificial Sequence
  Description of Artificial Sequence: Synthetic oligonucleotide
  Target: ANGPTL3; (+) strand; PAM type: YTN; PAM sequence: TTC
attttgctttcacaatacta

SEQ ID NO: 16221 - DNA, 20 bp, Artificial Sequence
  Description of Artificial Sequence: Synthetic oligonucleotide
  Target: ANGPTL3; (+) strand; PAM type: YTN; PAM sequence: TTT
tgctttcacaatactatact

SEQ ID NO: 16222 - DNA, 20 bp, Artificial Sequence
  Description of Artificial Sequence: Synthetic oligonucleotide
  Target: ANGPTL3; (+) strand; PAM type: YTN; PAM sequence: TTT
gctttcacaatactatactc

SEQ ID NO: 16223 - DNA, 20 bp, Artificial Sequence
  Description of Artificial Sequence: Synthetic oligonucleotide
  Target: ANGPTL3; (+) strand; PAM type: YTN; PAM sequence: TTG
ctttcacaatactatactct

SEQ ID NO: 16224 - DNA, 20 bp, Artificial Sequence
  Description of Artificial Sequence: Synthetic oligonucleotide
  Target: ANGPTL3; (+) strand; PAM type: YTN; PAM sequence: CTT
tcacaatactatactctcca

SEQ ID NO: 16225 - DNA, 20 bp, Artificial Sequence
  Description of Artificial Sequence: Synthetic oligonucleotide
  Target: ANGPTL3; (+) strand; PAM type: YTN; PAM sequence: TTT
cacaatactatactctccat

SEQ ID NO: 16226 - DNA, 20 bp, Artificial Sequence
  Description of Artificial Sequence: Synthetic oligonucleotide
  Target: ANGPTL3; (+) strand; PAM type: YTN; PAM sequence: TTC
acaatactatactctccatg

SEQ ID NO: 16227 - DNA, 20 bp, Artificial Sequence
  Description of Artificial Sequence: Synthetic oligonucleotide
  Target: ANGPTL3; (+) strand; PAM type: YTN; PAM sequence: CTA
tactctccatggattatccc

SEQ ID NO: 16228 - DNA, 20 bp, Artificial Sequence
  Description of Artificial Sequence: Synthetic oligonucleotide
  Target: ANGPTL3; (+) strand; PAM type: YTN; PAM sequence: CTC
tccatggattatcccttatc

SEQ ID NO: 16229 - DNA, 20 bp, Artificial Sequence
  Description of Artificial Sequence: Synthetic oligonucleotide
  Target: ANGPTL3; (+) strand; PAM type: YTN; PAM sequence: CTC
catggattatcccttatctg

SEQ ID NO: 16230 - DNA, 20 bp, Artificial Sequence
  Description of Artificial Sequence: Synthetic oligonucleotide
  Target: ANGPTL3; (+) strand; PAM type: YTN; PAM sequence: TTA
tcccttatctgaatccatct

SEQ ID NO: 16231 - DNA, 20 bp, Artificial Sequence
  Description of Artificial Sequence: Synthetic oligonucleotide
  Target: ANGPTL3; (+) strand; PAM type: YTN; PAM sequence: CTT
atctgaatccatctttataa

SEQ ID NO: 16232 - DNA, 20 bp, Artificial Sequence
  Description of Artificial Sequence: Synthetic oligonucleotide
  Target: ANGPTL3; (+) strand; PAM type: YTN; PAM sequence: TTA
tctgaatccatctttataac

SEQ ID NO: 16233 - DNA, 20 bp, Artificial Sequence
  Description of Artificial Sequence: Synthetic oligonucleotide
  Target: ANGPTL3; (+) strand; PAM type: YTN; PAM sequence: CTG
aatccatctttataacccta

SEQ ID NO: 16234 - DNA, 20 bp, Artificial Sequence
  Description of Artificial Sequence: Synthetic oligonucleotide
  Target: ANGPTL3; (+) strand; PAM type: YTN; PAM sequence: CTT
tataaccctattcctttctc

SEQ ID NO: 16235 - DNA, 20 bp, Artificial Sequence
  Description of Artificial Sequence: Synthetic oligonucleotide
  Target: ANGPTL3; (+) strand; PAM type: YTN; PAM sequence: TTT
ataaccctattcctttctca

SEQ ID NO: 16236 - DNA, 20 bp, Artificial Sequence
  Description of Artificial Sequence: Synthetic oligonucleotide
  Target: ANGPTL3; (+) strand; PAM type: YTN; PAM sequence: TTA
taaccctattcctttctcat

SEQ ID NO: 16237 - DNA, 20 bp, Artificial Sequence
  Description of Artificial Sequence: Synthetic oligonucleotide
  Target: ANGPTL3; (+) strand; PAM type: YTN; PAM sequence: CTA
ttcctttctcatatttagta

SEQ ID NO: 16238 - DNA, 20 bp, Artificial Sequence
  Description of Artificial Sequence: Synthetic oligonucleotide
  Target: ANGPTL3; (+) strand; PAM type: YTN; PAM sequence: TTC
ctttctcatatttagtactg

SEQ ID NO: 16239 - DNA, 20 bp, Artificial Sequence
  Description of Artificial Sequence: Synthetic oligonucleotide
  Target: ANGPTL3; (+) strand; PAM type: YTN; PAM sequence: CTT
tctcatatttagtactgtgg

SEQ ID NO: 16240 - DNA, 20 bp, Artificial Sequence
  Description of Artificial Sequence: Synthetic oligonucleotide
  Target: ANGPTL3; (+) strand; PAM type: YTN; PAM sequence: TTT
ctcatatttagtactgtggg

SEQ ID NO: 16241 - DNA, 20 bp, Artificial Sequence
  Description of Artificial Sequence: Synthetic oligonucleotide
  Target: ANGPTL3; (+) strand; PAM type: YTN; PAM sequence: TTC
tcatatttagtactgtgggc

SEQ ID NO: 16242 - DNA, 20 bp, Artificial Sequence
  Description of Artificial Sequence: Synthetic oligonucleotide
  Target: ANGPTL3; (+) strand; PAM type: YTN; PAM sequence: CTC
atatttagtactgtgggcca

SEQ ID NO: 16243 - DNA, 20 bp, Artificial Sequence
  Description of Artificial Sequence: Synthetic oligonucleotide
  Target: ANGPTL3; (+) strand; PAM type: YTN; PAM sequence: TTT
agtactgtgggccaatggac

SEQ ID NO: 16244 - DNA, 20 bp, Artificial Sequence
  Description of Artificial Sequence: Synthetic oligonucleotide
  Target: ANGPTL3; (+) strand; PAM type: YTN; PAM sequence: TTA
gtactgtgggccaatggaca

SEQ ID NO: 16245 - DNA, 20 bp, Artificial Sequence
  Description of Artificial Sequence: Synthetic oligonucleotide
  Target: ANGPTL3; (+) strand; PAM type: YTN; PAM sequence: CTG
tgggccaatggacaaccttc

SEQ ID NO: 16246 - DNA, 20 bp, Artificial Sequence
  Description of Artificial Sequence: Synthetic oligonucleotide
  Target: ANGPTL3; (+) strand; PAM type: YTN; PAM sequence: CTT
caatcatcttttctacactg

SEQ ID NO: 16247 - DNA, 20 bp, Artificial Sequence
  Description of Artificial Sequence: Synthetic oligonucleotide
  Target: ANGPTL3; (+) strand; PAM type: YTN; PAM sequence: TTC
aatcatcttttctacactga

SEQ ID NO: 16248 - DNA, 20 bp, Artificial Sequence
  Description of Artificial Sequence: Synthetic oligonucleotide
  Target: ANGPTL3; (+) strand; PAM type: YTN; PAM sequence: CTT
ttctacactgaccctcagac

SEQ ID NO: 16249 - DNA, 20 bp, Artificial Sequence
  Description of Artificial Sequence: Synthetic oligonucleotide
  Target: ANGPTL3; (+) strand; PAM type: YTN; PAM sequence: TTT
tctacactgaccctcagaca

SEQ ID NO: 16250 - DNA, 20 bp, Artificial Sequence
  Description of Artificial Sequence: Synthetic oligonucleotide
  Target: ANGPTL3; (+) strand; PAM type: YTN; PAM sequence: TTT
ctacactgaccctcagacat

SEQ ID NO: 16251 - DNA, 20 bp, Artificial Sequence
  Description of Artificial Sequence: Synthetic oligonucleotide
  Target: ANGPTL3; (+) strand; PAM type: YTN; PAM sequence: TTC
tacactgaccctcagacatt

SEQ ID NO: 16252 - DNA, 20 bp, Artificial Sequence
  Description of Artificial Sequence: Synthetic oligonucleotide
  Target: ANGPTL3; (+) strand; PAM type: YTN; PAM sequence: CTA
cactgaccctcagacattct

SEQ ID NO: 16253 - DNA, 20 bp, Artificial Sequence
  Description of Artificial Sequence: Synthetic oligonucleotide
  Target: ANGPTL3; (+) strand; PAM type: YTN; PAM sequence: CTG
accctcagacattctatctg

SEQ ID NO: 16254 - DNA, 20 bp, Artificial Sequence
  Description of Artificial Sequence: Synthetic oligonucleotide
  Target: ANGPTL3; (+) strand; PAM type: YTN; PAM sequence: CTC
agacattctatctgctctca

SEQ ID NO: 16255 - DNA, 20 bp, Artificial Sequence
  Description of Artificial Sequence: Synthetic oligonucleotide
  Target: ANGPTL3; (+) strand; PAM type: YTN; PAM sequence: TTC
tatctgctctcacggactcc

SEQ ID NO: 16256 - DNA, 20 bp, Artificial Sequence
  Description of Artificial Sequence: Synthetic oligonucleotide
  Target: ANGPTL3; (+) strand; PAM type: YTN; PAM sequence: CTA
tctgctctcacggactcctt

SEQ ID NO: 16257 - DNA, 20 bp, Artificial Sequence
  Description of Artificial Sequence: Synthetic oligonucleotide
  Target: ANGPTL3; (+) strand; PAM type: YTN; PAM sequence: CTG
ctctcacggactcctttatt

SEQ ID NO: 16258 - DNA, 20 bp, Artificial Sequence
  Description of Artificial Sequence: Synthetic oligonucleotide
  Target: ANGPTL3; (+) strand; PAM type: YTN; PAM sequence: CTC
tcacggactcctttatttac

SEQ ID NO: 16259 - DNA, 20 bp, Artificial Sequence
  Description of Artificial Sequence: Synthetic oligonucleotide
  Target: ANGPTL3; (+) strand; PAM type: YTN; PAM sequence: CTC
acggactcctttatttacca

SEQ ID NO: 16260 - DNA, 20 bp, Artificial Sequence
  Description of Artificial Sequence: Synthetic oligonucleotide
  Target: ANGPTL3; (+) strand; PAM type: YTN; PAM sequence: CTC
ctttatttaccatgaataaa

SEQ ID NO: 16261 - DNA, 20 bp, Artificial Sequence
  Description of Artificial Sequence: Synthetic oligonucleotide
  Target: ANGPTL3; (+) strand; PAM type: YTN; PAM sequence: CTT
tatttaccatgaataaagtt

SEQ ID NO: 16262 - DNA, 20 bp, Artificial Sequence
  Description of Artificial Sequence: Synthetic oligonucleotide
  Target: ANGPTL3; (+) strand; PAM type: YTN; PAM sequence: TTT
atttaccatgaataaagttc

SEQ ID NO: 16263 - DNA, 20 bp, Artificial Sequence
  Description of Artificial Sequence: Synthetic oligonucleotide
  Target: ANGPTL3; (+) strand; PAM type: YTN; PAM sequence: TTA
tttaccatgaataaagttcc

SEQ ID NO: 16264 - DNA, 20 bp, Artificial Sequence
  Description of Artificial Sequence: Synthetic oligonucleotide
  Target: ANGPTL3; (+) strand; PAM type: YTN; PAM sequence: TTT
accatgaataaagttccaaa

SEQ ID NO: 16265 - DNA, 20 bp, Artificial Sequence
  Description of Artificial Sequence: Synthetic oligonucleotide
  Target: ANGPTL3; (+) strand; PAM type: YTN; PAM sequence: TTA
ccatgaataaagttccaaaa

SEQ ID NO: 16266 - DNA, 20 bp, Artificial Sequence
  Description of Artificial Sequence: Synthetic oligonucleotide
  Target: ANGPTL3; (+) strand; PAM type: YTN; PAM sequence: TTC
caaaatctacatattcatcc

SEQ ID NO: 16267 - DNA, 20 bp, Artificial Sequence
  Description of Artificial Sequence: Synthetic oligonucleotide
  Target: ANGPTL3; (+) strand; PAM type: YTN; PAM sequence: CTA
catattcatcccaagtctct

SEQ ID NO: 16268 - DNA, 20 bp, Artificial Sequence
  Description of Artificial Sequence: Synthetic oligonucleotide
  Target: ANGPTL3; (+) strand; PAM type: YTN; PAM sequence: TTC
atcccaagtctctttccagt

SEQ ID NO: 16269 - DNA, 20 bp, Artificial Sequence
  Description of Artificial Sequence: Synthetic oligonucleotide
  Target: ANGPTL3; (+) strand; PAM type: YTN; PAM sequence: CTC
tttccagttccccttcttac

SEQ ID NO: 16270 - DNA, 20 bp, Artificial Sequence
  Description of Artificial Sequence: Synthetic oligonucleotide
  Target: ANGPTL3; (+) strand; PAM type: YTN; PAM sequence: CTT
tccagttccccttcttacat

SEQ ID NO: 16271 - DNA, 20 bp, Artificial Sequence
  Description of Artificial Sequence: Synthetic oligonucleotide
  Target: ANGPTL3; (+) strand; PAM type: YTN; PAM sequence: TTT
ccagttccccttcttacatt

SEQ ID NO: 16272 - DNA, 20 bp, Artificial Sequence
  Description of Artificial Sequence: Synthetic oligonucleotide
  Target: ANGPTL3; (+) strand; PAM type: YTN; PAM sequence: TTC
cagttccccttcttacattg

SEQ ID NO: 16273 - DNA, 20 bp, Artificial Sequence
  Description of Artificial Sequence: Synthetic oligonucleotide
  Target: ANGPTL3; (+) strand; PAM type: YTN; PAM sequence: TTC
cccttcttacattgcctatt

SEQ ID NO: 16274 - DNA, 20 bp, Artificial Sequence
  Description of Artificial Sequence: Synthetic oligonucleotide
  Target: ANGPTL3; (+) strand; PAM type: YTN; PAM sequence: CTT
cttacattgcctatttgcca

SEQ ID NO: 16275 - DNA, 20 bp, Artificial Sequence
  Description of Artificial Sequence: Synthetic oligonucleotide
  Target: ANGPTL3; (+) strand; PAM type: YTN; PAM sequence: TTC
ttacattgcctatttgccat

SEQ ID NO: 16276 - DNA, 20 bp, Artificial Sequence
  Description of Artificial Sequence: Synthetic oligonucleotide
  Target: ANGPTL3; (+) strand; PAM type: YTN; PAM sequence: CTT
acattgcctatttgccattt

SEQ ID NO: 16277 - DNA, 20 bp, Artificial Sequence
  Description of Artificial Sequence: Synthetic oligonucleotide
  Target: ANGPTL3; (+) strand; PAM type: YTN; PAM sequence: TTA
cattgcctatttgccatttc

SEQ ID NO: 16278 - DNA, 20 bp, Artificial Sequence
  Description of Artificial Sequence: Synthetic oligonucleotide
  Target: ANGPTL3; (+) strand; PAM type: YTN; PAM sequence: TTG
cctatttgccatttctccct

SEQ ID NO: 16279 - DNA, 20 bp, Artificial Sequence
  Description of Artificial Sequence: Synthetic oligonucleotide
  Target: ANGPTL3; (+) strand; PAM type: YTN; PAM sequence: CTA
tttgccatttctcccttcaa

SEQ ID NO: 16280 - DNA, 20 bp, Artificial Sequence
  Description of Artificial Sequence: Synthetic oligonucleotide
  Target: ANGPTL3; (+) strand; PAM type: YTN; PAM sequence: TTT
gccatttctcccttcaatac

SEQ ID NO: 16281 - DNA, 20 bp, Artificial Sequence
  Description of Artificial Sequence: Synthetic oligonucleotide
  Target: ANGPTL3; (+) strand; PAM type: YTN; PAM sequence: TTG
ccatttctcccttcaatacc

SEQ ID NO: 16282 - DNA, 20 bp, Artificial Sequence
  Description of Artificial Sequence: Synthetic oligonucleotide
  Target: ANGPTL3; (+) strand; PAM type: YTN; PAM sequence: TTT
ctcccttcaataccctatac

SEQ ID NO: 16283 - DNA, 20 bp, Artificial Sequence
  Description of Artificial Sequence: Synthetic oligonucleotide
  Target: ANGPTL3; (+) strand; PAM type: YTN; PAM sequence: TTC
tcccttcaataccctatact

SEQ ID NO: 16284 - DNA, 20 bp, Artificial Sequence
  Description of Artificial Sequence: Synthetic oligonucleotide
  Target: ANGPTL3; (+) strand; PAM type: YTN; PAM sequence: CTC
ccttcaataccctatacttc

SEQ ID NO: 16285 - DNA, 20 bp, Artificial Sequence
  Description of Artificial Sequence: Synthetic oligonucleotide
  Target: ANGPTL3; (+) strand; PAM type: YTN; PAM sequence: CTT
caataccctatacttcactc

SEQ ID NO: 16286 - DNA, 20 bp, Artificial Sequence
  Description of Artificial Sequence: Synthetic oligonucleotide
  Target: ANGPTL3; (+) strand; PAM type: YTN; PAM sequence: TTC
aataccctatacttcactca

SEQ ID NO: 16287 - DNA, 20 bp, Artificial Sequence
  Description of Artificial Sequence: Synthetic oligonucleotide
  Target: ANGPTL3; (+) strand; PAM type: YTN; PAM sequence: CTA
tacttcactcaaattcaaca

SEQ ID NO: 16288 - DNA, 20 bp, Artificial Sequence
  Description of Artificial Sequence: Synthetic oligonucleotide
  Target: ANGPTL3; (+) strand; PAM type: YTN; PAM sequence: CTT
cactcaaattcaacatacca

SEQ ID NO: 16289 - DNA, 20 bp, Artificial Sequence
  Description of Artificial Sequence: Synthetic oligonucleotide
  Target: ANGPTL3; (+) strand; PAM type: YTN; PAM sequence: TTC
actcaaattcaacataccaa

SEQ ID NO: 16290 - DNA, 20 bp, Artificial Sequence
  Description of Artificial Sequence: Synthetic oligonucleotide
  Target: ANGPTL3; (+) strand; PAM type: YTN; PAM sequence: CTC
aaattcaacataccaaaaat

SEQ ID NO: 16291 - DNA, 20 bp, Artificial Sequence
  Description of Artificial Sequence: Synthetic oligonucleotide
  Target: ANGPTL3; (+) strand; PAM type: YTN; PAM sequence: TTC
aacataccaaaaataaaagg

SEQ ID NO: 16292 - DNA, 20 bp, Artificial Sequence
  Description of Artificial Sequence: Synthetic oligonucleotide
  Target: ANGPTL3; (+) strand; PAM type: YTN; PAM sequence: CTC
acacctgtaatcccaggact

SEQ ID NO: 16293 - DNA, 20 bp, Artificial Sequence
  Description of Artificial Sequence: Synthetic oligonucleotide
  Target: ANGPTL3; (+) strand; PAM type: YTN; PAM sequence: CTG
taatcccaggactttgggag

SEQ ID NO: 16294 - DNA, 20 bp, Artificial Sequence
  Description of Artificial Sequence: Synthetic oligonucleotide
  Target: ANGPTL3; (+) strand; PAM type: YTN; PAM sequence: CTT
tgggaggctgaggcaggtgg

SEQ ID NO: 16295 - DNA, 20 bp, Artificial Sequence
  Description of Artificial Sequence: Synthetic oligonucleotide
  Target: ANGPTL3; (+) strand; PAM type: YTN; PAM sequence: TTT
gggaggctgaggcaggtgga

SEQ ID NO: 16296 - DNA, 20 bp, Artificial Sequence
  Description of Artificial Sequence: Synthetic oligonucleotide
  Target: ANGPTL3; (+) strand; PAM type: YTN; PAM sequence: TTG
ggaggctgaggcaggtggat

SEQ ID NO: 16297 - DNA, 20 bp, Artificial Sequence
  Description of Artificial Sequence: Synthetic oligonucleotide
  Target: ANGPTL3; (+) strand; PAM type: YTN; PAM sequence: CTG
aggcaggtggatcacctgag

SEQ ID NO: 16298 - DNA, 20 bp, Artificial Sequence
  Description of Artificial Sequence: Synthetic oligonucleotide
  Target: ANGPTL3; (+) strand; PAM type: YTN; PAM sequence: CTG
aggtcaggagtctgaccagc

SEQ ID NO: 16299 - DNA, 20 bp, Artificial Sequence
  Description of Artificial Sequence: Synthetic oligonucleotide
  Target: ANGPTL3; (+) strand; PAM type: YTN; PAM sequence: CTG
accagcctgaccaatatggt

SEQ ID NO: 16300 - DNA, 20 bp, Artificial Sequence
  Description of Artificial Sequence: Synthetic oligonucleotide
  Target: ANGPTL3; (+) strand; PAM type: YTN; PAM sequence: CTG
accaatatggtgaaaccccg

SEQ ID NO: 16301 - DNA, 20 bp, Artificial Sequence
  Description of Artificial Sequence: Synthetic oligonucleotide
  Target: ANGPTL3; (+) strand; PAM type: YTN; PAM sequence: CTC
tacctaaaatacaaaaatta

SEQ ID NO: 16302 - DNA, 20 bp, Artificial Sequence
  Description of Artificial Sequence: Synthetic oligonucleotide
  Target: ANGPTL3; (+) strand; PAM type: YTN; PAM sequence: CTA
cctaaaatacaaaaattagc

SEQ ID NO: 16303 - DNA, 20 bp, Artificial Sequence
  Description of Artificial Sequence: Synthetic oligonucleotide
  Target: ANGPTL3; (+) strand; PAM type: YTN; PAM sequence: CTA
aaatacaaaaattagccagg

SEQ ID NO: 16304 - DNA, 20 bp, Artificial Sequence
  Description of Artificial Sequence: Synthetic oligonucleotide
  Target: ANGPTL3; (+) strand; PAM type: YTN; PAM sequence: TTA
gccaggcgtggtggcatgtg

SEQ ID NO: 16305 - DNA, 20 bp, Artificial Sequence
  Description of Artificial Sequence: Synthetic oligonucleotide
  Target: ANGPTL3; (+) strand; PAM type: YTN; PAM sequence: CTA
cagtcccagctactcaagag

SEQ ID NO: 16306 - DNA, 20 bp, Artificial Sequence
  Description of Artificial Sequence: Synthetic oligonucleotide
  Target: ANGPTL3; (+) strand; PAM type: YTN; PAM sequence: CTA
ctcaagaggctgagacagga

SEQ ID NO: 16307 - DNA, 20 bp, Artificial Sequence
  Description of Artificial Sequence: Synthetic oligonucleotide
  Target: ANGPTL3; (+) strand; PAM type: YTN; PAM sequence: CTC
aagaggctgagacaggagaa

SEQ ID NO: 16308 - DNA, 20 bp, Artificial Sequence
  Description of Artificial Sequence: Synthetic oligonucleotide
  Target: ANGPTL3; (+) strand; PAM type: YTN; PAM sequence: CTG
agacaggagaatcgcttgaa

SEQ ID NO: 16309 - DNA, 20 bp, Artificial Sequence
  Description of Artificial Sequence: Synthetic oligonucleotide
  Target: ANGPTL3; (+) strand; PAM type: YTN; PAM sequence: CTT
gaacccaggaggcggaggtt

SEQ ID NO: 16310 - DNA, 20 bp, Artificial Sequence
  Description of Artificial Sequence: Synthetic oligonucleotide
  Target: ANGPTL3; (+) strand; PAM type: YTN; PAM sequence: TTG
aacccaggaggcggaggttg

SEQ ID NO: 16311 - DNA, 20 bp, Artificial Sequence
  Description of Artificial Sequence: Synthetic oligonucleotide
  Target: ANGPTL3; (+) strand; PAM type: YTN; PAM sequence: TTG
cagtgagctgagatcacacc

SEQ ID NO: 16312 - DNA, 20 bp, Artificial Sequence
  Description of Artificial Sequence: Synthetic oligonucleotide
  Target: ANGPTL3; (+) strand; PAM type: YTN; PAM sequence: CTG
agatcacaccaatgcactgg

SEQ ID NO: 16313 - DNA, 20 bp, Artificial Sequence
  Description of Artificial Sequence: Synthetic oligonucleotide
  Target: ANGPTL3; (+) strand; PAM type: YTN; PAM sequence: CTG
ggtgacagaacaagactgac

SEQ ID NO: 16314 - DNA, 20 bp, Artificial Sequence
  Description of Artificial Sequence: Synthetic oligonucleotide
  Target: ANGPTL3; (+) strand; PAM type: YTN; PAM sequence: CTG
actcaaaaaaaaataaataa

SEQ ID NO: 16315 - DNA, 20 bp, Artificial Sequence
  Description of Artificial Sequence: Synthetic oligonucleotide
  Target: ANGPTL3; (+) strand; PAM type: YTN; PAM sequence: CTC
aaaaaaaaataaataacaaa

SEQ ID NO: 16316 - DNA, 20 bp, Artificial Sequence
  Description of Artificial Sequence: Synthetic oligonucleotide
  Target: ANGPTL3; (+) strand; PAM type: YTN; PAM sequence: TTC
cccagccccttactgctact

SEQ ID NO: 16317 - DNA, 20 bp, Artificial Sequence
  Description of Artificial Sequence: Synthetic oligonucleotide
  Target: ANGPTL3; (+) strand; PAM type: YTN; PAM sequence: CTT
actgctactgctatcccttt

SEQ ID NO: 16318 - DNA, 20 bp, Artificial Sequence
  Description of Artificial Sequence: Synthetic oligonucleotide
  Target: ANGPTL3; (+) strand; PAM type: YTN; PAM sequence: TTA
ctgctactgctatccctttc

SEQ ID NO: 16319 - DNA, 20 bp, Artificial Sequence
  Description of Artificial Sequence: Synthetic oligonucleotide
  Target: ANGPTL3; (+) strand; PAM type: YTN; PAM sequence: CTG
ctactgctatccctttctac

SEQ ID NO: 16320 - DNA, 20 bp, Artificial Sequence
  Description of Artificial Sequence: Synthetic oligonucleotide
  Target: ANGPTL3; (+) strand; PAM type: YTN; PAM sequence: CTA
ctgctatccctttctaccca

SEQ ID NO: 16321 - DNA, 20 bp, Artificial Sequence
  Description of Artificial Sequence: Synthetic oligonucleotide
  Target: ANGPTL3; (+) strand; PAM type: YTN; PAM sequence: CTG
ctatccctttctacccacct

SEQ ID NO: 16322 - DNA, 20 bp, Artificial Sequence
  Description of Artificial Sequence: Synthetic oligonucleotide
  Target: ANGPTL3; (+) strand; PAM type: YTN; PAM sequence: CTA
tccctttctacccacctttc

SEQ ID NO: 16323 - DNA, 20 bp, Artificial Sequence
  Description of Artificial Sequence: Synthetic oligonucleotide
  Target: ANGPTL3; (+) strand; PAM type: YTN; PAM sequence: CTT
tctacccacctttccctcct

SEQ ID NO: 16324 - DNA, 20 bp, Artificial Sequence
  Description of Artificial Sequence: Synthetic oligonucleotide
  Target: ANGPTL3; (+) strand; PAM type: YTN; PAM sequence: TTT
ctacccacctttccctcctt

SEQ ID NO: 16325 - DNA, 20 bp, Artificial Sequence
  Description of Artificial Sequence: Synthetic oligonucleotide
  Target: ANGPTL3; (+) strand; PAM type: YTN; PAM sequence: TTC
tacccacctttccctccttt

SEQ ID NO: 16326 - DNA, 20 bp, Artificial Sequence
  Description of Artificial Sequence: Synthetic oligonucleotide
  Target: ANGPTL3; (+) strand; PAM type: YTN; PAM sequence: CTA
cccacctttccctcctttat

SEQ ID NO: 16327 - DNA, 20 bp, Artificial Sequence
  Description of Artificial Sequence: Synthetic oligonucleotide
  Target: ANGPTL3; (+) strand; PAM type: YTN; PAM sequence: CTT
tccctcctttatactctttc

SEQ ID NO: 16328 - DNA, 20 bp, Artificial Sequence
  Description of Artificial Sequence: Synthetic oligonucleotide
  Target: ANGPTL3; (+) strand; PAM type: YTN; PAM sequence: TTT
ccctcctttatactctttca

SEQ ID NO: 16329 - DNA, 20 bp, Artificial Sequence
  Description of Artificial Sequence: Synthetic oligonucleotide
  Target: ANGPTL3; (+) strand; PAM type: YTN; PAM sequence: TTC
cctcctttatactctttcac

SEQ ID NO: 16330 - DNA, 20 bp, Artificial Sequence
  Description of Artificial Sequence: Synthetic oligonucleotide
  Target: ANGPTL3; (+) strand; PAM type: YTN; PAM sequence: CTC
ctttatactctttcacacca

SEQ ID NO: 16331 - DNA, 20 bp, Artificial Sequence
  Description of Artificial Sequence: Synthetic oligonucleotide
  Target: ANGPTL3; (+) strand; PAM type: YTN; PAM sequence: CTT
tatactctttcacaccatct

SEQ ID NO: 16332 - DNA, 20 bp, Artificial Sequence
  Description of Artificial Sequence: Synthetic oligonucleotide
  Target: ANGPTL3; (+) strand; PAM type: YTN; PAM sequence: TTT
atactctttcacaccatctt

SEQ ID NO: 16333 - DNA, 20 bp, Artificial Sequence
  Description of Artificial Sequence: Synthetic oligonucleotide
  Target: ANGPTL3; (+) strand; PAM type: YTN; PAM sequence: TTA
tactctttcacaccatcttc

SEQ ID NO: 16334 - DNA, 20 bp, Artificial Sequence
  Description of Artificial Sequence: Synthetic oligonucleotide
  Target: ANGPTL3; (+) strand; PAM type: YTN; PAM sequence: CTC
tttcacaccatcttcctcac

SEQ ID NO: 16335 - DNA, 20 bp, Artificial Sequence
  Description of Artificial Sequence: Synthetic oligonucleotide
  Target: ANGPTL3; (+) strand; PAM type: YTN; PAM sequence: CTT
tcacaccatcttcctcactt

SEQ ID NO: 16336 - DNA, 20 bp, Artificial Sequence
  Description of Artificial Sequence: Synthetic oligonucleotide
  Target: ANGPTL3; (+) strand; PAM type: YTN; PAM sequence: TTT
cacaccatcttcctcacttc

SEQ ID NO: 16337 - DNA, 20 bp, Artificial Sequence
  Description of Artificial Sequence: Synthetic oligonucleotide
  Target: ANGPTL3; (+) strand; PAM type: YTN; PAM sequence: TTC
acaccatcttcctcacttct

SEQ ID NO: 16338 - DNA, 20 bp, Artificial Sequence
  Description of Artificial Sequence: Synthetic oligonucleotide
  Target: ANGPTL3; (+) strand; PAM type: YTN; PAM sequence: CTT
cctcacttctttatatccat

SEQ ID NO: 16339 - DNA, 20 bp, Artificial Sequence
  Description of Artificial Sequence: Synthetic oligonucleotide
  Target: ANGPTL3; (+) strand; PAM type: YTN; PAM sequence: TTC
ctcacttctttatatccatt

SEQ ID NO: 16340 - DNA, 20 bp, Artificial Sequence
  Description of Artificial Sequence: Synthetic oligonucleotide
  Target: ANGPTL3; (+) strand; PAM type: YTN; PAM sequence: CTC
acttctttatatccattaat

SEQ ID NO: 16341 - DNA, 20 bp, Artificial Sequence
  Description of Artificial Sequence: Synthetic oligonucleotide
  Target: ANGPTL3; (+) strand; PAM type: YTN; PAM sequence: CTT
ctttatatccattaatatga

SEQ ID NO: 16342 - DNA, 20 bp, Artificial Sequence
  Description of Artificial Sequence: Synthetic oligonucleotide
  Target: ANGPTL3; (+) strand; PAM type: YTN; PAM sequence: TTC
tttatatccattaatatgac

SEQ ID NO: 16343 - DNA, 20 bp, Artificial Sequence
  Description of Artificial Sequence: Synthetic oligonucleotide
  Target: ANGPTL3; (+) strand; PAM type: YTN; PAM sequence: CTT
tatatccattaatatgacca

SEQ ID NO: 16344 - DNA, 20 bp, Artificial Sequence
  Description of Artificial Sequence: Synthetic oligonucleotide
  Target: ANGPTL3; (+) strand; PAM type: YTN; PAM sequence: TTT
atatccattaatatgaccag

SEQ ID NO: 16345 - DNA, 20 bp, Artificial Sequence
  Description of Artificial Sequence: Synthetic oligonucleotide
  Target: ANGPTL3; (+) strand; PAM type: YTN; PAM sequence: TTA
tatccattaatatgaccagc

SEQ ID NO: 16346 - DNA, 20 bp, Artificial Sequence
  Description of Artificial Sequence: Synthetic oligonucleotide
  Target: ANGPTL3; (+) strand; PAM type: YTN; PAM sequence: TTA
atatgaccagcatgttccca

SEQ ID NO: 16347 - DNA, 20 bp, Artificial Sequence
  Description of Artificial Sequence: Synthetic oligonucleotide
  Target: ANGPTL3; (+) strand; PAM type: YTN; PAM sequence: TTC
ccagtcacagaagcctggaa

SEQ ID NO: 16348 - DNA, 20 bp, Artificial Sequence
  Description of Artificial Sequence: Synthetic oligonucleotide
  Target: ANGPTL3; (+) strand; PAM type: YTN; PAM sequence: CTG
gaacccggaagacatctctg

SEQ ID NO: 16349 - DNA, 20 bp, Artificial Sequence
  Description of Artificial Sequence: Synthetic oligonucleotide
  Target: ANGPTL3; (+) strand; PAM type: YTN; PAM sequence: CTC
tggcttttcactcaactttg

SEQ ID NO: 16350 - DNA, 20 bp, Artificial Sequence
  Description of Artificial Sequence: Synthetic oligonucleotide
  Target: ANGPTL3; (+) strand; PAM type: YTN; PAM sequence: CTG
gcttttcactcaactttgta

SEQ ID NO: 16351 - DNA, 20 bp, Artificial Sequence
  Description of Artificial Sequence: Synthetic oligonucleotide
  Target: ANGPTL3; (+) strand; PAM type: YTN; PAM sequence: CTT
ttcactcaactttgtaaact

SEQ ID NO: 16352 - DNA, 20 bp, Artificial Sequence
  Description of Artificial Sequence: Synthetic oligonucleotide
  Target: ANGPTL3; (+) strand; PAM type: YTN; PAM sequence: TTT
tcactcaactttgtaaacta

SEQ ID NO: 16353 - DNA, 20 bp, Artificial Sequence
  Description of Artificial Sequence: Synthetic oligonucleotide
  Target: ANGPTL3; (+) strand; PAM type: YTN; PAM sequence: TTT
cactcaactttgtaaactac

SEQ ID NO: 16354 - DNA, 20 bp, Artificial Sequence
  Description of Artificial Sequence: Synthetic oligonucleotide
  Target: ANGPTL3; (+) strand; PAM type: YTN; PAM sequence: TTC
actcaactttgtaaactacc

SEQ ID NO: 16355 - DNA, 20 bp, Artificial Sequence
  Description of Artificial Sequence: Synthetic oligonucleotide
  Target: ANGPTL3; (+) strand; PAM type: YTN; PAM sequence: CTC
aactttgtaaactacctctt

SEQ ID NO: 16356 - DNA, 20 bp, Artificial Sequence
  Description of Artificial Sequence: Synthetic oligonucleotide
  Target: ANGPTL3; (+) strand; PAM type: YTN; PAM sequence: CTT
tgtaaactacctcttttgta

SEQ ID NO: 16357 - DNA, 20 bp, Artificial Sequence
  Description of Artificial Sequence: Synthetic oligonucleotide
  Target: ANGPTL3; (+) strand; PAM type: YTN; PAM sequence: TTT
gtaaactacctcttttgtat

SEQ ID NO: 16358 - DNA, 20 bp, Artificial Sequence
  Description of Artificial Sequence: Synthetic oligonucleotide
  Target: ANGPTL3; (+) strand; PAM type: YTN; PAM sequence: TTG
taaactacctcttttgtatc

SEQ ID NO: 16359 - DNA, 20 bp, Artificial Sequence
  Description of Artificial Sequence: Synthetic oligonucleotide
  Target: ANGPTL3; (+) strand; PAM type: YTN; PAM sequence: CTA
cctcttttgtatcataagcc

SEQ ID NO: 16360 - DNA, 20 bp, Artificial Sequence
  Description of Artificial Sequence: Synthetic oligonucleotide
  Target: ANGPTL3; (+) strand; PAM type: YTN; PAM sequence: CTC
ttttgtatcataagccacca

SEQ ID NO: 16361 - DNA, 20 bp, Artificial Sequence
  Description of Artificial Sequence: Synthetic oligonucleotide
  Target: ANGPTL3; (+) strand; PAM type: YTN; PAM sequence: CTT
ttgtatcataagccaccaag

SEQ ID NO: 16362 - DNA, 20 bp, Artificial Sequence
  Description of Artificial Sequence: Synthetic oligonucleotide
  Target: ANGPTL3; (+) strand; PAM type: YTN; PAM sequence: TTT
tgtatcataagccaccaagt

SEQ ID NO: 16363 - DNA, 20 bp, Artificial Sequence
  Description of Artificial Sequence: Synthetic oligonucleotide
  Target: ANGPTL3; (+) strand; PAM type: YTN; PAM sequence: TTT
gtatcataagccaccaagtt

SEQ ID NO: 16364 - DNA, 20 bp, Artificial Sequence
  Description of Artificial Sequence: Synthetic oligonucleotide
  Target: ANGPTL3; (+) strand; PAM type: YTN; PAM sequence: TTG
tatcataagccaccaagttc

SEQ ID NO: 16365 - DNA, 20 bp, Artificial Sequence
  Description of Artificial Sequence: Synthetic oligonucleotide
  Target: ANGPTL3; (+) strand; PAM type: YTN; PAM sequence: TTC
aatacaatcttctcttgaaa

SEQ ID NO: 16366 - DNA, 20 bp, Artificial Sequence
  Description of Artificial Sequence: Synthetic oligonucleotide
  Target: ANGPTL3; (+) strand; PAM type: YTN; PAM sequence: CTT
ctcttgaaacgtctcttaat

SEQ ID NO: 16367 - DNA, 20 bp, Artificial Sequence
  Description of Artificial Sequence: Synthetic oligonucleotide
  Target: ANGPTL3; (+) strand; PAM type: YTN; PAM sequence: TTC
tcttgaaacgtctcttaatc

SEQ ID NO: 16368 - DNA, 20 bp, Artificial Sequence
  Description of Artificial Sequence: Synthetic oligonucleotide
  Target: ANGPTL3; (+) strand; PAM type: YTN; PAM sequence: CTC
ttgaaacgtctcttaatctt

SEQ ID NO: 16369 - DNA, 20 bp, Artificial Sequence
  Description of Artificial Sequence: Synthetic oligonucleotide
  Target: ANGPTL3; (+) strand; PAM type: YTN; PAM sequence: CTT
gaaacgtctcttaatcttat

SEQ ID NO: 16370 - DNA, 20 bp, Artificial Sequence
  Description of Artificial Sequence: Synthetic oligonucleotide
  Target: ANGPTL3; (+) strand; PAM type: YTN; PAM sequence: TTG
aaacgtctcttaatcttata

SEQ ID NO: 16371 - DNA, 20 bp, Artificial Sequence
  Description of Artificial Sequence: Synthetic oligonucleotide
  Target: ANGPTL3; (+) strand; PAM type: YTN; PAM sequence: CTC
ttaatcttataagctttctt

SEQ ID NO: 16372 - DNA, 20 bp, Artificial Sequence
  Description of Artificial Sequence: Synthetic oligonucleotide
  Target: ANGPTL3; (+) strand; PAM type: YTN; PAM sequence: CTT
aatcttataagctttcttcc

SEQ ID NO: 16373 - DNA, 20 bp, Artificial Sequence
  Description of Artificial Sequence: Synthetic oligonucleotide
  Target: ANGPTL3; (+) strand; PAM type: YTN; PAM sequence: TTA
atcttataagctttcttccc

SEQ ID NO: 16374 - DNA, 20 bp, Artificial Sequence
  Description of Artificial Sequence: Synthetic oligonucleotide
  Target: ANGPTL3; (+) strand; PAM type: YTN; PAM sequence: CTT
ataagctttcttccccaaag

SEQ ID NO: 16375 - DNA, 20 bp, Artificial Sequence
  Description of Artificial Sequence: Synthetic oligonucleotide
  Target: ANGPTL3; (+) strand; PAM type: YTN; PAM sequence: TTA
taagctttcttccccaaaga

SEQ ID NO: 16376 - DNA, 20 bp, Artificial Sequence
  Description of Artificial Sequence: Synthetic oligonucleotide
  Target: ANGPTL3; (+) strand; PAM type: YTN; PAM sequence: CTT
tcttccccaaagactgtctt

SEQ ID NO: 16377 - DNA, 20 bp, Artificial Sequence
  Description of Artificial Sequence: Synthetic oligonucleotide
  Target: ANGPTL3; (+) strand; PAM type: YTN; PAM sequence: TTT
cttccccaaagactgtcttt

SEQ ID NO: 16378 - DNA, 20 bp, Artificial Sequence
  Description of Artificial Sequence: Synthetic oligonucleotide
  Target: ANGPTL3; (+) strand; PAM type: YTN; PAM sequence: TTC
ttccccaaagactgtcttta

SEQ ID NO: 16379 - DNA, 20 bp, Artificial Sequence
  Description of Artificial Sequence: Synthetic oligonucleotide
  Target: ANGPTL3; (+) strand; PAM type: YTN; PAM sequence: CTT
ccccaaagactgtctttaac

SEQ ID NO: 16380 - DNA, 20 bp, Artificial Sequence
  Description of Artificial Sequence: Synthetic oligonucleotide
  Target: ANGPTL3; (+) strand; PAM type: YTN; PAM sequence: TTC
cccaaagactgtctttaact

SEQ ID NO: 16381 - DNA, 20 bp, Artificial Sequence
  Description of Artificial Sequence: Synthetic oligonucleotide
  Target: ANGPTL3; (+) strand; PAM type: YTN; PAM sequence: CTG
tctttaacttcagtgctaga

SEQ ID NO: 16382 - DNA, 20 bp, Artificial Sequence
  Description of Artificial Sequence: Synthetic oligonucleotide
  Target: ANGPTL3; (+) strand; PAM type: YTN; PAM sequence: CTT
taacttcagtgctagattat

SEQ ID NO: 16383 - DNA, 20 bp, Artificial Sequence
  Description of Artificial Sequence: Synthetic oligonucleotide
  Target: ANGPTL3; (+) strand; PAM type: YTN; PAM sequence: TTT
aacttcagtgctagattata

SEQ ID NO: 16384 - DNA, 20 bp, Artificial Sequence
  Description of Artificial Sequence: Synthetic oligonucleotide
  Target: ANGPTL3; (+) strand; PAM type: YTN; PAM sequence: TTA
acttcagtgctagattatat

SEQ ID NO: 16385 - DNA, 20 bp, Artificial Sequence
  Description of Artificial Sequence: Synthetic oligonucleotide
  Target: ANGPTL3; (+) strand; PAM type: YTN; PAM sequence: CTT
cagtgctagattatataagt

SEQ ID NO: 16386 - DNA, 20 bp, Artificial Sequence
  Description of Artificial Sequence: Synthetic oligonucleotide
  Target: ANGPTL3; (+) strand; PAM type: YTN; PAM sequence: TTC
agtgctagattatataagta

SEQ ID NO: 16387 - DNA, 20 bp, Artificial Sequence
  Description of Artificial Sequence: Synthetic oligonucleotide
  Target: ANGPTL3; (+) strand; PAM type: YTN; PAM sequence: CTA
gattatataagtagtctctt

SEQ ID NO: 16388 - DNA, 20 bp, Artificial Sequence
  Description of Artificial Sequence: Synthetic oligonucleotide
  Target: ANGPTL3; (+) strand; PAM type: YTN; PAM sequence: TTA
tataagtagtctcttctttc

SEQ ID NO: 16389 - DNA, 20 bp, Artificial Sequence
  Description of Artificial Sequence: Synthetic oligonucleotide
  Target: ANGPTL3; (+) strand; PAM type: YTN; PAM sequence: CTC
ttctttcctcctaattttac

SEQ ID NO: 16390 - DNA, 20 bp, Artificial Sequence
  Description of Artificial Sequence: Synthetic oligonucleotide
  Target: ANGPTL3; (+) strand; PAM type: YTN; PAM sequence: CTT
ctttcctcctaattttacgt

SEQ ID NO: 16391 - DNA, 20 bp, Artificial Sequence
  Description of Artificial Sequence: Synthetic oligonucleotide
  Target: ANGPTL3; (+) strand; PAM type: YTN; PAM sequence: TTC
tttcctcctaattttacgtc

SEQ ID NO: 16392 - DNA, 20 bp, Artificial Sequence
  Description of Artificial Sequence: Synthetic oligonucleotide
  Target: ANGPTL3; (+) strand; PAM type: YTN; PAM sequence: CTT
tcctcctaattttacgtccc

SEQ ID NO: 16393 - DNA, 20 bp, Artificial Sequence
  Description of Artificial Sequence: Synthetic oligonucleotide
  Target: ANGPTL3; (+) strand; PAM type: YTN; PAM sequence: TTT
cctcctaattttacgtccct

SEQ ID NO: 16394 - DNA, 20 bp, Artificial Sequence
  Description of Artificial Sequence: Synthetic oligonucleotide
  Target: ANGPTL3; (+) strand; PAM type: YTN; PAM sequence: TTC
ctcctaattttacgtccctc

SEQ ID NO: 16395 - DNA, 20 bp, Artificial Sequence
  Description of Artificial Sequence: Synthetic oligonucleotide
  Target: ANGPTL3; (+) strand; PAM type: YTN; PAM sequence: CTC
ctaattttacgtccctctcc

SEQ ID NO: 16396 - DNA, 20 bp, Artificial Sequence
  Description of Artificial Sequence: Synthetic oligonucleotide
  Target: ANGPTL3; (+) strand; PAM type: YTN; PAM sequence: CTA
attttacgtccctctccctg

SEQ ID NO: 16397 - DNA, 20 bp, Artificial Sequence
  Description of Artificial Sequence: Synthetic oligonucleotide
  Target: ANGPTL3; (+) strand; PAM type: YTN; PAM sequence: TTT
tacgtccctctccctgtcaa

SEQ ID NO: 16398 - DNA, 20 bp, Artificial Sequence
  Description of Artificial Sequence: Synthetic oligonucleotide
  Target: ANGPTL3; (+) strand; PAM type: YTN; PAM sequence: TTT
acgtccctctccctgtcaat

SEQ ID NO: 16399 - DNA, 20 bp, Artificial Sequence
  Description of Artificial Sequence: Synthetic oligonucleotide
  Target: ANGPTL3; (+) strand; PAM type: YTN; PAM sequence: TTA
cgtccctctccctgtcaatc

SEQ ID NO: 16400 - DNA, 20 bp, Artificial Sequence
  Description of Artificial Sequence: Synthetic oligonucleotide
  Target: ANGPTL3; (+) strand; PAM type: YTN; PAM sequence: CTC
tccctgtcaatcttccgaaa

SEQ ID NO: 16401 - DNA, 20 bp, Artificial Sequence
  Description of Artificial Sequence: Synthetic oligonucleotide
  Target: ANGPTL3; (+) strand; PAM type: YTN; PAM sequence: CTC
cctgtcaatcttccgaaaag

SEQ ID NO: 16402 - DNA, 20 bp, Artificial Sequence
  Description of Artificial Sequence: Synthetic oligonucleotide
  Target: ANGPTL3; (+) strand; PAM type: YTN; PAM sequence: CTG
tcaatcttccgaaaaggaat

SEQ ID NO: 16403 - DNA, 20 bp, Artificial Sequence
  Description of Artificial Sequence: Synthetic oligonucleotide
  Target: ANGPTL3; (+) strand; PAM type: YTN; PAM sequence: CTT
ccgaaaaggaatttgtaatg

SEQ ID NO: 16404 - DNA, 20 bp, Artificial Sequence
  Description of Artificial Sequence: Synthetic oligonucleotide
  Target: ANGPTL3; (+) strand; PAM type: YTN; PAM sequence: TTC
cgaaaaggaatttgtaatgg

SEQ ID NO: 16405 - DNA, 20 bp, Artificial Sequence
  Description of Artificial Sequence: Synthetic oligonucleotide
  Target: ANGPTL3; (+) strand; PAM type: YTN; PAM sequence: TTT
gtaatggctgcatactgcct

SEQ ID NO: 16406 - DNA, 20 bp, Artificial Sequence
  Description of Artificial Sequence: Synthetic oligonucleotide
  Target: ANGPTL3; (+) strand; PAM type: YTN; PAM sequence: TTG
taatggctgcatactgcctg

SEQ ID NO: 16407 - DNA, 20 bp, Artificial Sequence
  Description of Artificial Sequence: Synthetic oligonucleotide
  Target: ANGPTL3; (+) strand; PAM type: YTN; PAM sequence: CTG
catactgcctggacctgtgt

SEQ ID NO: 16408 - DNA, 20 bp, Artificial Sequence
  Description of Artificial Sequence: Synthetic oligonucleotide
  Target: ANGPTL3; (+) strand; PAM type: YTN; PAM sequence: CTG
cctggacctgtgtctttcaa

SEQ ID NO: 16409 - DNA, 20 bp, Artificial Sequence
  Description of Artificial Sequence: Synthetic oligonucleotide
  Target: ANGPTL3; (+) strand; PAM type: YTN; PAM sequence: CTG
gacctgtgtctttcaagctc

SEQ ID NO: 16410 - DNA, 20 bp, Artificial Sequence
  Description of Artificial Sequence: Synthetic oligonucleotide
  Target: ANGPTL3; (+) strand; PAM type: YTN; PAM sequence: CTG
tgtctttcaagctcatctac

SEQ ID NO: 16411 - DNA, 20 bp, Artificial Sequence
  Description of Artificial Sequence: Synthetic oligonucleotide
  Target: ANGPTL3; (+) strand; PAM type: YTN; PAM sequence: CTT
tcaagctcatctactgaaga

SEQ ID NO: 16412 - DNA, 20 bp, Artificial Sequence
  Description of Artificial Sequence: Synthetic oligonucleotide
  Target: ANGPTL3; (+) strand; PAM type: YTN; PAM sequence: TTT
caagctcatctactgaagaa

SEQ ID NO: 16413 - DNA, 20 bp, Artificial Sequence
  Description of Artificial Sequence: Synthetic oligonucleotide
  Target: ANGPTL3; (+) strand; PAM type: YTN; PAM sequence: TTC
aagctcatctactgaagaag

SEQ ID NO: 16414 - DNA, 20 bp, Artificial Sequence
  Description of Artificial Sequence: Synthetic oligonucleotide
  Target: ANGPTL3; (+) strand; PAM type: YTN; PAM sequence: CTC
atctactgaagaagtgtaac

SEQ ID NO: 16415 - DNA, 20 bp, Artificial Sequence
  Description of Artificial Sequence: Synthetic oligonucleotide
  Target: ANGPTL3; (+) strand; PAM type: YTN; PAM sequence: CTA
ctgaagaagtgtaacagcag

SEQ ID NO: 16416 - DNA, 20 bp, Artificial Sequence
  Description of Artificial Sequence: Synthetic oligonucleotide
  Target: ANGPTL3; (+) strand; PAM type: YTN; PAM sequence: CTG
aagaagtgtaacagcagagg

SEQ ID NO: 16417 - DNA, 20 bp, Artificial Sequence
  Description of Artificial Sequence: Synthetic oligonucleotide
  Target: ANGPTL3; (+) strand; PAM type: YTN; PAM sequence: CTT
ttattgtctggagttacagg

SEQ ID NO: 16418 - DNA, 20 bp, Artificial Sequence
  Description of Artificial Sequence: Synthetic oligonucleotide
  Target: ANGPTL3; (+) strand; PAM type: YTN; PAM sequence: TTT
tattgtctggagttacagga

SEQ ID NO: 16419 - DNA, 20 bp, Artificial Sequence
  Description of Artificial Sequence: Synthetic oligonucleotide
  Target: ANGPTL3; (+) strand; PAM type: YTN; PAM sequence: TTT
attgtctggagttacaggat

SEQ ID NO: 16420 - DNA, 20 bp, Artificial Sequence
  Description of Artificial Sequence: Synthetic oligonucleotide
  Target: ANGPTL3; (+) strand; PAM type: YTN; PAM sequence: TTA
ttgtctggagttacaggata

SEQ ID NO: 16421 - DNA, 20 bp, Artificial Sequence
  Description of Artificial Sequence: Synthetic oligonucleotide
  Target: ANGPTL3; (+) strand; PAM type: YTN; PAM sequence: TTG
tctggagttacaggataaaa

SEQ ID NO: 16422 - DNA, 20 bp, Artificial Sequence
  Description of Artificial Sequence: Synthetic oligonucleotide
  Target: ANGPTL3; (+) strand; PAM type: YTN; PAM sequence: CTG
gagttacaggataaaataac

SEQ ID NO: 16423 - DNA, 20 bp, Artificial Sequence
  Description of Artificial Sequence: Synthetic oligonucleotide
  Target: ANGPTL3; (+) strand; PAM type: YTN; PAM sequence: TTA
caggataaaataacttacta

SEQ ID NO: 16424 - DNA, 20 bp, Artificial Sequence
  Description of Artificial Sequence: Synthetic oligonucleotide
  Target: ANGPTL3; (+) strand; PAM type: YTN; PAM sequence: CTT
actatatgcacaaatttctt

SEQ ID NO: 16425 - DNA, 20 bp, Artificial Sequence
  Description of Artificial Sequence: Synthetic oligonucleotide
  Target: ANGPTL3; (+) strand; PAM type: YTN; PAM sequence: TTA
ctatatgcacaaatttcttt

SEQ ID NO: 16426 - DNA, 20 bp, Artificial Sequence
  Description of Artificial Sequence: Synthetic oligonucleotide
  Target: ANGPTL3; (+) strand; PAM type: YTN; PAM sequence: CTA
tatgcacaaatttctttcag

SEQ ID NO: 16427 - DNA, 20 bp, Artificial Sequence
  Description of Artificial Sequence: Synthetic oligonucleotide
  Target: ANGPTL3; (+) strand; PAM type: YTN; PAM sequence: TTT
ctttcagaatcttattggga

SEQ ID NO: 16428 - DNA, 20 bp, Artificial Sequence
  Description of Artificial Sequence: Synthetic oligonucleotide
  Target: ANGPTL3; (+) strand; PAM type: YTN; PAM sequence: TTC
tttcagaatcttattgggat

SEQ ID NO: 16429 - DNA, 20 bp, Artificial Sequence
  Description of Artificial Sequence: Synthetic oligonucleotide
  Target: ANGPTL3; (+) strand; PAM type: YTN; PAM sequence: CTT
tcagaatcttattgggatct

SEQ ID NO: 16430 - DNA, 20 bp, Artificial Sequence
  Description of Artificial Sequence: Synthetic oligonucleotide
  Target: ANGPTL3; (+) strand; PAM type: YTN; PAM sequence: TTT
cagaatcttattgggatctt

SEQ ID NO: 16431 - DNA, 20 bp, Artificial Sequence
  Description of Artificial Sequence: Synthetic oligonucleotide
  Target: ANGPTL3; (+) strand; PAM type: YTN; PAM sequence: TTC
agaatcttattgggatctta

SEQ ID NO: 16432 - DNA, 20 bp, Artificial Sequence
  Description of Artificial Sequence: Synthetic oligonucleotide
  Target: ANGPTL3; (+) strand; PAM type: YTN; PAM sequence: CTT
attgggatcttagcttaaat

SEQ ID NO: 16433 - DNA, 20 bp, Artificial Sequence
  Description of Artificial Sequence: Synthetic oligonucleotide
  Target: ANGPTL3; (+) strand; PAM type: YTN; PAM sequence: TTA
ttgggatcttagcttaaatc

SEQ ID NO: 16434 - DNA, 20 bp, Artificial Sequence
  Description of Artificial Sequence: Synthetic oligonucleotide
  Target: ANGPTL3; (+) strand; PAM type: YTN; PAM sequence: TTG
ggatcttagcttaaatctta

SEQ ID NO: 16435 - DNA, 20 bp, Artificial Sequence
  Description of Artificial Sequence: Synthetic oligonucleotide
  Target: ANGPTL3; (+) strand; PAM type: YTN; PAM sequence: CTT
agcttaaatcttagaatttt

SEQ ID NO: 16436 - DNA, 20 bp, Artificial Sequence
  Description of Artificial Sequence: Synthetic oligonucleotide
  Target: ANGPTL3; (+) strand; PAM type: YTN; PAM sequence: TTA
gcttaaatcttagaatttta

SEQ ID NO: 16437 - DNA, 20 bp, Artificial Sequence
  Description of Artificial Sequence: Synthetic oligonucleotide
  Target: ANGPTL3; (+) strand; PAM type: YTN; PAM sequence: CTT
aaatcttagaattttacttt

SEQ ID NO: 16438 - DNA, 20 bp, Artificial Sequence
  Description of Artificial Sequence: Synthetic oligonucleotide
  Target: ANGPTL3; (+) strand; PAM type: YTN; PAM sequence: TTA
aatcttagaattttacttta

SEQ ID NO: 16439 - DNA, 20 bp, Artificial Sequence
  Description of Artificial Sequence: Synthetic oligonucleotide
  Target: ANGPTL3; (+) strand; PAM type: YTN; PAM sequence: CTT
agaattttactttaaaattg

SEQ ID NO: 16440 - DNA, 20 bp, Artificial Sequence
  Description of Artificial Sequence: Synthetic oligonucleotide
  Target: ANGPTL3; (+) strand; PAM type: YTN; PAM sequence: TTA
gaattttactttaaaattgc

SEQ ID NO: 16441 - DNA, 20 bp, Artificial Sequence
  Description of Artificial Sequence: Synthetic oligonucleotide
  Target: ANGPTL3; (+) strand; PAM type: YTN; PAM sequence: TTT
tactttaaaattgcatatga

SEQ ID NO: 16442 - DNA, 20 bp, Artificial Sequence
  Description of Artificial Sequence: Synthetic oligonucleotide
  Target: ANGPTL3; (+) strand; PAM type: YTN; PAM sequence: TTT
actttaaaattgcatatgaa

SEQ ID NO: 16443 - DNA, 20 bp, Artificial Sequence
  Description of Artificial Sequence: Synthetic oligonucleotide
  Target: ANGPTL3; (+) strand; PAM type: YTN; PAM sequence: TTA
ctttaaaattgcatatgaat

SEQ ID NO: 16444 - DNA, 20 bp, Artificial Sequence
  Description of Artificial Sequence: Synthetic oligonucleotide
  Target: ANGPTL3; (+) strand; PAM type: YTN; PAM sequence: CTT
taaaattgcatatgaattgt

SEQ ID NO: 16445 - DNA, 20 bp, Artificial Sequence
  Description of Artificial Sequence: Synthetic oligonucleotide
  Target: ANGPTL3; (+) strand; PAM type: YTN; PAM sequence: TTT
aaaattgcatatgaattgtg

SEQ ID NO: 16446 - DNA, 20 bp, Artificial Sequence
  Description of Artificial Sequence: Synthetic oligonucleotide
  Target: ANGPTL3; (+) strand; PAM type: YTN; PAM sequence: TTA
aaattgcatatgaattgtgt

SEQ ID NO: 16447 - DNA, 20 bp, Artificial Sequence
  Description of Artificial Sequence: Synthetic oligonucleotide
  Target: ANGPTL3; (+) strand; PAM type: YTN; PAM sequence: TTG
catatgaattgtgttttata

SEQ ID NO: 16448 - DNA, 20 bp, Artificial Sequence
  Description of Artificial Sequence: Synthetic oligonucleotide
  Target: ANGPTL3; (+) strand; PAM type: YTN; PAM sequence: TTG
tgttttatactttataaatc

SEQ ID NO: 16449 - DNA, 20 bp, Artificial Sequence
  Description of Artificial Sequence: Synthetic oligonucleotide
  Target: ANGPTL3; (+) strand; PAM type: YTN; PAM sequence: TTT
tatactttataaatctatct

SEQ ID NO: 16450 - DNA, 20 bp, Artificial Sequence
  Description of Artificial Sequence: Synthetic oligonucleotide
  Target: ANGPTL3; (+) strand; PAM type: YTN; PAM sequence: TTT
atactttataaatctatctt

SEQ ID NO: 16451 - DNA, 20 bp, Artificial Sequence
  Description of Artificial Sequence: Synthetic oligonucleotide
  Target: ANGPTL3; (+) strand; PAM type: YTN; PAM sequence: TTA
tactttataaatctatcttc

SEQ ID NO: 16452 - DNA, 20 bp, Artificial Sequence
  Description of Artificial Sequence: Synthetic oligonucleotide
  Target: ANGPTL3; (+) strand; PAM type: YTN; PAM sequence: CTT
tataaatctatcttcatgcc

SEQ ID NO: 16453 - DNA, 20 bp, Artificial Sequence
  Description of Artificial Sequence: Synthetic oligonucleotide
  Target: ANGPTL3; (+) strand; PAM type: YTN; PAM sequence: TTT
ataaatctatcttcatgcct

SEQ ID NO: 16454 - DNA, 20 bp, Artificial Sequence
  Description of Artificial Sequence: Synthetic oligonucleotide
  Target: ANGPTL3; (+) strand; PAM type: YTN; PAM sequence: TTA
taaatctatcttcatgcctg

SEQ ID NO: 16455 - DNA, 20 bp, Artificial Sequence
  Description of Artificial Sequence: Synthetic oligonucleotide
  Target: ANGPTL3; (+) strand; PAM type: YTN; PAM sequence: CTA
tcttcatgcctgcagtggct

SEQ ID NO: 16456 - DNA, 20 bp, Artificial Sequence
  Description of Artificial Sequence: Synthetic oligonucleotide
  Target: ANGPTL3; (+) strand; PAM type: YTN; PAM sequence: CTT
catgcctgcagtggctcaca

SEQ ID NO: 16457 - DNA, 20 bp, Artificial Sequence
  Description of Artificial Sequence: Synthetic oligonucleotide
  Target: ANGPTL3; (+) strand; PAM type: YTN; PAM sequence: TTC
atgcctgcagtggctcacac

SEQ ID NO: 16458 - DNA, 20 bp, Artificial Sequence
  Description of Artificial Sequence: Synthetic oligonucleotide
  Target: ANGPTL3; (+) strand; PAM type: YTN; PAM sequence: CTG
cagtggctcacacctgtaat

SEQ ID NO: 16459 - DNA, 20 bp, Artificial Sequence
  Description of Artificial Sequence: Synthetic oligonucleotide
  Target: ANGPTL3; (+) strand; PAM type: YTN; PAM sequence: CTC
acacctgtaatccaagtatt

SEQ ID NO: 16460 - DNA, 20 bp, Artificial Sequence
  Description of Artificial Sequence: Synthetic oligonucleotide
  Target: ANGPTL3; (+) strand; PAM type: YTN; PAM sequence: CTG
taatccaagtattttgggag

SEQ ID NO: 16461 - DNA, 20 bp, Artificial Sequence
  Description of Artificial Sequence: Synthetic oligonucleotide
  Target: ANGPTL3; (+) strand; PAM type: YTN; PAM sequence: TTT
tgggaggccggggcgggagt

SEQ ID NO: 16462 - DNA, 20 bp, Artificial Sequence
  Description of Artificial Sequence: Synthetic oligonucleotide
  Target: ANGPTL3; (+) strand; PAM type: YTN; PAM sequence: TTT
gggaggccggggcgggagta

SEQ ID NO: 16463 - DNA, 20 bp, Artificial Sequence
  Description of Artificial Sequence: Synthetic oligonucleotide
  Target: ANGPTL3; (+) strand; PAM type: YTN; PAM sequence: TTG
ggaggccggggcgggagtac

SEQ ID NO: 16464 - DNA, 20 bp, Artificial Sequence
  Description of Artificial Sequence: Synthetic oligonucleotide
  Target: ANGPTL3; (+) strand; PAM type: YTN; PAM sequence: CTG
cttgaacccaggagtccaag

SEQ ID NO: 16465 - DNA, 20 bp, Artificial Sequence
  Description of Artificial Sequence: Synthetic oligonucleotide
  Target: ANGPTL3; (+) strand; PAM type: YTN; PAM sequence: CTT
gaacccaggagtccaagatc

SEQ ID NO: 16466 - DNA, 20 bp, Artificial Sequence
  Description of Artificial Sequence: Synthetic oligonucleotide
  Target: ANGPTL3; (+) strand; PAM type: YTN; PAM sequence: TTG
aacccaggagtccaagatca

SEQ ID NO: 16467 - DNA, 20 bp, Artificial Sequence
  Description of Artificial Sequence: Synthetic oligonucleotide
  Target: ANGPTL3; (+) strand; PAM type: YTN; PAM sequence: CTG
tgcaacacggcaaaactcca

SEQ ID NO: 16468 - DNA, 20 bp, Artificial Sequence
  Description of Artificial Sequence: Synthetic oligonucleotide
  Target: ANGPTL3; (+) strand; PAM type: YTN; PAM sequence: CTC
cacctctacaaaaaatacaa

SEQ ID NO: 16469 - DNA, 20 bp, Artificial Sequence
  Description of Artificial Sequence: Synthetic oligonucleotide
  Target: ANGPTL3; (+) strand; PAM type: YTN; PAM sequence: CTC
tacaaaaaatacaaaaatta

SEQ ID NO: 16470 - DNA, 20 bp, Artificial Sequence
  Description of Artificial Sequence: Synthetic oligonucleotide
  Target: ANGPTL3; (+) strand; PAM type: YTN; PAM sequence: CTA
caaaaaatacaaaaattagc

SEQ ID NO: 16471 - DNA, 20 bp, Artificial Sequence
  Description of Artificial Sequence: Synthetic oligonucleotide
  Target: ANGPTL3; (+) strand; PAM type: YTN; PAM sequence: TTA
gctgggtgtggtggcaggtg

SEQ ID NO: 16472 - DNA, 20 bp, Artificial Sequence
  Description of Artificial Sequence: Synthetic oligonucleotide
  Target: ANGPTL3; (+) strand; PAM type: YTN; PAM sequence: CTG
ggtgtggtggcaggtgcctg

SEQ ID NO: 16473 - DNA, 20 bp, Artificial Sequence
  Description of Artificial Sequence: Synthetic oligonucleotide
  Target: ANGPTL3; (+) strand; PAM type: YTN; PAM sequence: CTG
taatcccaactacttgggag

SEQ ID NO: 16474 - DNA, 20 bp, Artificial Sequence
  Description of Artificial Sequence: Synthetic oligonucleotide
  Target: ANGPTL3; (+) strand; PAM type: YTN; PAM sequence: CTA
cttgggaggctgaggcagga

SEQ ID NO: 16475 - DNA, 20 bp, Artificial Sequence
  Description of Artificial Sequence: Synthetic oligonucleotide
  Target: ANGPTL3; (+) strand; PAM type: YTN; PAM sequence: CTT
gggaggctgaggcaggagaa

SEQ ID NO: 16476 - DNA, 20 bp, Artificial Sequence
  Description of Artificial Sequence: Synthetic oligonucleotide
  Target: ANGPTL3; (+) strand; PAM type: YTN; PAM sequence: TTG
ggaggctgaggcaggagaat

SEQ ID NO: 16477 - DNA, 20 bp, Artificial Sequence
  Description of Artificial Sequence: Synthetic oligonucleotide
  Target: ANGPTL3; (+) strand; PAM type: YTN; PAM sequence: CTG
aggcaggagaatcgctggag

SEQ ID NO: 16478 - DNA, 20 bp, Artificial Sequence
  Description of Artificial Sequence: Synthetic oligonucleotide
  Target: ANGPTL3; (+) strand; PAM type: YTN; PAM sequence: CTG
gagcctgggaagtcaagcct

SEQ ID NO: 16479 - DNA, 20 bp, Artificial Sequence
  Description of Artificial Sequence: Synthetic oligonucleotide
  Target: ANGPTL3; (+) strand; PAM type: YTN; PAM sequence: CTG
ggaagtcaagcctgcagcga

SEQ ID NO: 16480 - DNA, 20 bp, Artificial Sequence
  Description of Artificial Sequence: Synthetic oligonucleotide
  Target: ANGPTL3; (+) strand; PAM type: YTN; PAM sequence: CTG
cagcgaaccatgatcctaac

SEQ ID NO: 16481 - DNA, 20 bp, Artificial Sequence
  Description of Artificial Sequence: Synthetic oligonucleotide
  Target: ANGPTL3; (+) strand; PAM type: YTN; PAM sequence: CTA
acactgcattctagcctggg

SEQ ID NO: 16482 - DNA, 20 bp, Artificial Sequence
  Description of Artificial Sequence: Synthetic oligonucleotide
  Target: ANGPTL3; (+) strand; PAM type: YTN; PAM sequence: CTG
cattctagcctgggcaacag

SEQ ID NO: 16483 - DNA, 20 bp, Artificial Sequence
  Description of Artificial Sequence: Synthetic oligonucleotide
  Target: ANGPTL3; (+) strand; PAM type: YTN; PAM sequence: TTC
tagcctgggcaacagagtga

SEQ ID NO: 16484 - DNA, 20 bp, Artificial Sequence
  Description of Artificial Sequence: Synthetic oligonucleotide
  Target: ANGPTL3; (+) strand; PAM type: YTN; PAM sequence: CTA
gcctgggcaacagagtgaga

SEQ ID NO: 16485 - DNA, 20 bp, Artificial Sequence
  Description of Artificial Sequence: Synthetic oligonucleotide
  Target: ANGPTL3; (+) strand; PAM type: YTN; PAM sequence: CTG
ggcaacagagtgagactctg

SEQ ID NO: 16486 - DNA, 20 bp, Artificial Sequence
  Description of Artificial Sequence: Synthetic oligonucleotide
  Target: ANGPTL3; (+) strand; PAM type: YTN; PAM sequence: CTC
tgtctcaaaaaaaatcttca

SEQ ID NO: 16487 - DNA, 20 bp, Artificial Sequence
  Description of Artificial Sequence: Synthetic oligonucleotide
  Target: ANGPTL3; (+) strand; PAM type: YTN; PAM sequence: CTG
tctcaaaaaaaatcttcata

SEQ ID NO: 16488 - DNA, 20 bp, Artificial Sequence
  Description of Artificial Sequence: Synthetic oligonucleotide
  Target: ANGPTL3; (+) strand; PAM type: YTN; PAM sequence: CTC
aaaaaaaatcttcatataaa

SEQ ID NO: 16489 - DNA, 20 bp, Artificial Sequence
  Description of Artificial Sequence: Synthetic oligonucleotide
  Target: ANGPTL3; (+) strand; PAM type: YTN; PAM sequence: CTT
catataaaaatatttatttc

SEQ ID NO: 16490 - DNA, 20 bp, Artificial Sequence
  Description of Artificial Sequence: Synthetic oligonucleotide
  Target: ANGPTL3; (+) strand; PAM type: YTN; PAM sequence: TTC
atataaaaatatttatttcc

SEQ ID NO: 16491 - DNA, 20 bp, Artificial Sequence
  Description of Artificial Sequence: Synthetic oligonucleotide
  Target: ANGPTL3; (+) strand; PAM type: YTN; PAM sequence: TTT
atttccccccaagtatttaa

SEQ ID NO: 16492 - DNA, 20 bp, Artificial Sequence
  Description of Artificial Sequence: Synthetic oligonucleotide
  Target: ANGPTL3; (+) strand; PAM type: YTN; PAM sequence: TTA
tttccccccaagtatttaaa

SEQ ID NO: 16493 - DNA, 20 bp, Artificial Sequence
  Description of Artificial Sequence: Synthetic oligonucleotide
  Target: ANGPTL3; (+) strand; PAM type: YTN; PAM sequence: TTT
ccccccaagtatttaaaaag

SEQ ID NO: 16494 - DNA, 20 bp, Artificial Sequence
  Description of Artificial Sequence: Synthetic oligonucleotide
  Target: ANGPTL3; (+) strand; PAM type: YTN; PAM sequence: TTC
cccccaagtatttaaaaagt

SEQ ID NO: 16495 - DNA, 20 bp, Artificial Sequence
  Description of Artificial Sequence: Synthetic oligonucleotide
  Target: ANGPTL3; (+) strand; PAM type: YTN; PAM sequence: TTT
aaaaagtgatgttcctagaa

SEQ ID NO: 16496 - DNA, 20 bp, Artificial Sequence
  Description of Artificial Sequence: Synthetic oligonucleotide
  Target: ANGPTL3; (+) strand; PAM type: YTN; PAM sequence: TTA
aaaagtgatgttcctagaag

SEQ ID NO: 16497 - DNA, 20 bp, Artificial Sequence
  Description of Artificial Sequence: Synthetic oligonucleotide
  Target: ANGPTL3; (+) strand; PAM type: YTN; PAM sequence: TTC
ctagaagatgtgtcatgttt

SEQ ID NO: 16498 - DNA, 20 bp, Artificial Sequence
  Description of Artificial Sequence: Synthetic oligonucleotide
  Target: ANGPTL3; (+) strand; PAM type: YTN; PAM sequence: CTA
gaagatgtgtcatgtttatc

SEQ ID NO: 16499 - DNA, 20 bp, Artificial Sequence
  Description of Artificial Sequence: Synthetic oligonucleotide
  Target: ANGPTL3; (+) strand; PAM type: YTN; PAM sequence: TTT
atcctgtgaacttgcacgtc

SEQ ID NO: 16500 - DNA, 20 bp, Artificial Sequence
  Description of Artificial Sequence: Synthetic oligonucleotide
  Target: ANGPTL3; (+) strand; PAM type: YTN; PAM sequence: TTA
tcctgtgaacttgcacgtcc

SEQ ID NO: 16501 - DNA, 20 bp, Artificial Sequence
  Description of Artificial Sequence: Synthetic oligonucleotide
  Target: ANGPTL3; (+) strand; PAM type: YTN; PAM sequence: CTG
tgaacttgcacgtcccatat

SEQ ID NO: 16502 - DNA, 20 bp, Artificial Sequence
  Description of Artificial Sequence: Synthetic oligonucleotide
  Target: ANGPTL3; (+) strand; PAM type: YTN; PAM sequence: CTT
gcacgtcccatatagttgtg

SEQ ID NO: 16503 - DNA, 20 bp, Artificial Sequence
  Description of Artificial Sequence: Synthetic oligonucleotide
  Target: ANGPTL3; (+) strand; PAM type: YTN; PAM sequence: TTG
cacgtcccatatagttgtgc

SEQ ID NO: 16504 - DNA, 20 bp, Artificial Sequence
  Description of Artificial Sequence: Synthetic oligonucleotide
  Target: ANGPTL3; (+) strand; PAM type: YTN; PAM sequence: TTG
tgccctcacaagaatgtata

SEQ ID NO: 16505 - DNA, 20 bp, Artificial Sequence
  Description of Artificial Sequence: Synthetic oligonucleotide
  Target: ANGPTL3; (+) strand; PAM type: YTN; PAM sequence: CTC
acaagaatgtatactccaat

SEQ ID NO: 16506 - DNA, 20 bp, Artificial Sequence
  Description of Artificial Sequence: Synthetic oligonucleotide
  Target: ANGPTL3; (+) strand; PAM type: YTN; PAM sequence: CTC
caattagaagagtataggcc

SEQ ID NO: 16507 - DNA, 20 bp, Artificial Sequence
  Description of Artificial Sequence: Synthetic oligonucleotide
  Target: ANGPTL3; (+) strand; PAM type: YTN; PAM sequence: TTA
gaagagtataggcctttgga

SEQ ID NO: 16508 - DNA, 20 bp, Artificial Sequence
  Description of Artificial Sequence: Synthetic oligonucleotide
  Target: ANGPTL3; (+) strand; PAM type: YTN; PAM sequence: CTT
tggaacaaaatccaaaatcc

SEQ ID NO: 16509 - DNA, 20 bp, Artificial Sequence
  Description of Artificial Sequence: Synthetic oligonucleotide
  Target: ANGPTL3; (+) strand; PAM type: YTN; PAM sequence: TTT
ggaacaaaatccaaaatcct

SEQ ID NO: 16510 - DNA, 20 bp, Artificial Sequence
  Description of Artificial Sequence: Synthetic oligonucleotide
  Target: ANGPTL3; (+) strand; PAM type: YTN; PAM sequence: TTG
gaacaaaatccaaaatcctt

SEQ ID NO: 16511 - DNA, 20 bp, Artificial Sequence
  Description of Artificial Sequence: Synthetic oligonucleotide
  Target: ANGPTL3; (+) strand; PAM type: YTN; PAM sequence: CTT
ccaggttttcaaaagtctct

SEQ ID NO: 16512 - DNA, 20 bp, Artificial Sequence
  Description of Artificial Sequence: Synthetic oligonucleotide
  Target: ANGPTL3; (+) strand; PAM type: YTN; PAM sequence: TTC
caggttttcaaaagtctcta

SEQ ID NO: 16513 - DNA, 20 bp, Artificial Sequence
  Description of Artificial Sequence: Synthetic oligonucleotide
  Target: ANGPTL3; (+) strand; PAM type: YTN; PAM sequence: TTT
tcaaaagtctctatcacctg

SEQ ID NO: 16514 - DNA, 20 bp, Artificial Sequence
  Description of Artificial Sequence: Synthetic oligonucleotide
  Target: ANGPTL3; (+) strand; PAM type: YTN; PAM sequence: TTT
caaaagtctctatcacctgg

SEQ ID NO: 16515 - DNA, 20 bp, Artificial Sequence
  Description of Artificial Sequence: Synthetic oligonucleotide
  Target: ANGPTL3; (+) strand; PAM type: YTN; PAM sequence: TTC
aaaagtctctatcacctggc

SEQ ID NO: 16516 - DNA, 20 bp, Artificial Sequence
  Description of Artificial Sequence: Synthetic oligonucleotide
  Target: ANGPTL3; (+) strand; PAM type: YTN; PAM sequence: CTC
tatcacctggccccaaatta

SEQ ID NO: 16517 - DNA, 20 bp, Artificial Sequence
  Description of Artificial Sequence: Synthetic oligonucleotide
  Target: ANGPTL3; (+) strand; PAM type: YTN; PAM sequence: CTA
tcacctggccccaaattacc

SEQ ID NO: 16518 - DNA, 20 bp, Artificial Sequence
  Description of Artificial Sequence: Synthetic oligonucleotide
  Target: ANGPTL3; (+) strand; PAM type: YTN; PAM sequence: CTG
gccccaaattacctcttcag

SEQ ID NO: 16519 - DNA, 20 bp, Artificial Sequence
  Description of Artificial Sequence: Synthetic oligonucleotide
  Target: ANGPTL3; (+) strand; PAM type: YTN; PAM sequence: TTA
cctcttcagccattttttcc

SEQ ID NO: 16520 - DNA, 20 bp, Artificial Sequence
  Description of Artificial Sequence: Synthetic oligonucleotide
  Target: ANGPTL3; (+) strand; PAM type: YTN; PAM sequence: CTC
ttcagccattttttcccaca

SEQ ID NO: 16521 - DNA, 20 bp, Artificial Sequence
  Description of Artificial Sequence: Synthetic oligonucleotide
  Target: ANGPTL3; (+) strand; PAM type: YTN; PAM sequence: CTT
cagccattttttcccacaac

SEQ ID NO: 16522 - DNA, 20 bp, Artificial Sequence
  Description of Artificial Sequence: Synthetic oligonucleotide
  Target: ANGPTL3; (+) strand; PAM type: YTN; PAM sequence: TTC
agccattttttcccacaaca

SEQ ID NO: 16523 - DNA, 20 bp, Artificial Sequence
  Description of Artificial Sequence: Synthetic oligonucleotide
  Target: ANGPTL3; (+) strand; PAM type: YTN; PAM sequence: TTT
tttcccacaacacaaacctt

SEQ ID NO: 16524 - DNA, 20 bp, Artificial Sequence
  Description of Artificial Sequence: Synthetic oligonucleotide
  Target: ANGPTL3; (+) strand; PAM type: YTN; PAM sequence: TTT
ttcccacaacacaaaccttc

SEQ ID NO: 16525 - DNA, 20 bp, Artificial Sequence
  Description of Artificial Sequence: Synthetic oligonucleotide
  Target: ANGPTL3; (+) strand; PAM type: YTN; PAM sequence: TTT
tcccacaacacaaaccttct

SEQ ID NO: 16526 - DNA, 20 bp, Artificial Sequence
  Description of Artificial Sequence: Synthetic oligonucleotide
  Target: ANGPTL3; (+) strand; PAM type: YTN; PAM sequence: TTT
cccacaacacaaaccttctg

SEQ ID NO: 16527 - DNA, 20 bp, Artificial Sequence
  Description of Artificial Sequence: Synthetic oligonucleotide
  Target: ANGPTL3; (+) strand; PAM type: YTN; PAM sequence: TTC
ccacaacacaaaccttctgc

SEQ ID NO: 16528 - DNA, 20 bp, Artificial Sequence
  Description of Artificial Sequence: Synthetic oligonucleotide
  Target: ANGPTL3; (+) strand; PAM type: YTN; PAM sequence: CTT
ctgctctcatcaaaacgatc

SEQ ID NO: 16529 - DNA, 20 bp, Artificial Sequence
  Description of Artificial Sequence: Synthetic oligonucleotide
  Target: ANGPTL3; (+) strand; PAM type: YTN; PAM sequence: TTC
tgctctcatcaaaacgatct

SEQ ID NO: 16530 - DNA, 20 bp, Artificial Sequence
  Description of Artificial Sequence: Synthetic oligonucleotide
  Target: ANGPTL3; (+) strand; PAM type: YTN; PAM sequence: CTG
ctctcatcaaaacgatctac

SEQ ID NO: 16531 - DNA, 20 bp, Artificial Sequence
  Description of Artificial Sequence: Synthetic oligonucleotide
  Target: ANGPTL3; (+) strand; PAM type: YTN; PAM sequence: CTC
tcatcaaaacgatctacttt

SEQ ID NO: 16532 - DNA, 20 bp, Artificial Sequence
  Description of Artificial Sequence: Synthetic oligonucleotide
  Target: ANGPTL3; (+) strand; PAM type: YTN; PAM sequence: CTC
atcaaaacgatctactttta

SEQ ID NO: 16533 - DNA, 20 bp, Artificial Sequence
  Description of Artificial Sequence: Synthetic oligonucleotide
  Target: ANGPTL3; (+) strand; PAM type: YTN; PAM sequence: CTA
cttttaaacatctcctctat

SEQ ID NO: 16534 - DNA, 20 bp, Artificial Sequence
  Description of Artificial Sequence: Synthetic oligonucleotide
  Target: ANGPTL3; (+) strand; PAM type: YTN; PAM sequence: CTT
ttaaacatctcctctatgcc

SEQ ID NO: 16535 - DNA, 20 bp, Artificial Sequence
  Description of Artificial Sequence: Synthetic oligonucleotide
  Target: ANGPTL3; (+) strand; PAM type: YTN; PAM sequence: TTT
taaacatctcctctatgcct

SEQ ID NO: 16536 - DNA, 20 bp, Artificial Sequence
  Description of Artificial Sequence: Synthetic oligonucleotide
  Target: ANGPTL3; (+) strand; PAM type: YTN; PAM sequence: TTT
aaacatctcctctatgcctt

SEQ ID NO: 16537 - DNA, 20 bp, Artificial Sequence
  Description of Artificial Sequence: Synthetic oligonucleotide
  Target: ANGPTL3; (+) strand; PAM type: YTN; PAM sequence: TTA
aacatctcctctatgccttc

SEQ ID NO: 16538 - DNA, 20 bp, Artificial Sequence
  Description of Artificial Sequence: Synthetic oligonucleotide
  Target: ANGPTL3; (+) strand; PAM type: YTN; PAM sequence: CTC
ctctatgccttcctaatgta

SEQ ID NO: 16539 - DNA, 20 bp, Artificial Sequence
  Description of Artificial Sequence: Synthetic oligonucleotide
  Target: ANGPTL3; (+) strand; PAM type: YTN; PAM sequence: CTC
tatgccttcctaatgtattc

SEQ ID NO: 16540 - DNA, 20 bp, Artificial Sequence
  Description of Artificial Sequence: Synthetic oligonucleotide
  Target: ANGPTL3; (+) strand; PAM type: YTN; PAM sequence: CTA
tgccttcctaatgtattcca

SEQ ID NO: 16541 - DNA, 20 bp, Artificial Sequence
  Description of Artificial Sequence: Synthetic oligonucleotide
  Target: ANGPTL3; (+) strand; PAM type: YTN; PAM sequence: CTT
cctaatgtattccatttgtc

SEQ ID NO: 16542 - DNA, 20 bp, Artificial Sequence
  Description of Artificial Sequence: Synthetic oligonucleotide
  Target: ANGPTL3; (+) strand; PAM type: YTN; PAM sequence: TTC
ctaatgtattccatttgtct

SEQ ID NO: 16543 - DNA, 20 bp, Artificial Sequence
  Description of Artificial Sequence: Synthetic oligonucleotide
  Target: ANGPTL3; (+) strand; PAM type: YTN; PAM sequence: CTA
atgtattccatttgtctaga

SEQ ID NO: 16544 - DNA, 20 bp, Artificial Sequence
  Description of Artificial Sequence: Synthetic oligonucleotide
  Target: ANGPTL3; (+) strand; PAM type: YTN; PAM sequence: TTC
catttgtctagaatgtctcc

SEQ ID NO: 16545 - DNA, 20 bp, Artificial Sequence
  Description of Artificial Sequence: Synthetic oligonucleotide
  Target: ANGPTL3; (+) strand; PAM type: YTN; PAM sequence: TTT
gtctagaatgtctccccaca

SEQ ID NO: 16546 - DNA, 20 bp, Artificial Sequence
  Description of Artificial Sequence: Synthetic oligonucleotide
  Target: ANGPTL3; (+) strand; PAM type: YTN; PAM sequence: TTG
tctagaatgtctccccacac

SEQ ID NO: 16547 - DNA, 20 bp, Artificial Sequence
  Description of Artificial Sequence: Synthetic oligonucleotide
  Target: ANGPTL3; (+) strand; PAM type: YTN; PAM sequence: CTA
gaatgtctccccacacattt

SEQ ID NO: 16548 - DNA, 20 bp, Artificial Sequence
  Description of Artificial Sequence: Synthetic oligonucleotide
  Target: ANGPTL3; (+) strand; PAM type: YTN; PAM sequence: CTC
cccacacatttctgattggc

SEQ ID NO: 16549 - DNA, 20 bp, Artificial Sequence
  Description of Artificial Sequence: Synthetic oligonucleotide
  Target: ANGPTL3; (+) strand; PAM type: YTN; PAM sequence: TTT
ctgattggctagattgtgcc

SEQ ID NO: 16550 - DNA, 20 bp, Artificial Sequence
  Description of Artificial Sequence: Synthetic oligonucleotide
  Target: ANGPTL3; (+) strand; PAM type: YTN; PAM sequence: TTC
tgattggctagattgtgccg

SEQ ID NO: 16551 - DNA, 20 bp, Artificial Sequence
  Description of Artificial Sequence: Synthetic oligonucleotide
  Target: ANGPTL3; (+) strand; PAM type: YTN; PAM sequence: CTG
attggctagattgtgccgta

SEQ ID NO: 16552 - DNA, 20 bp, Artificial Sequence
  Description of Artificial Sequence: Synthetic oligonucleotide
  Target: ANGPTL3; (+) strand; PAM type: YTN; PAM sequence: TTG
gctagattgtgccgtatttt

SEQ ID NO: 16553 - DNA, 20 bp, Artificial Sequence
  Description of Artificial Sequence: Synthetic oligonucleotide
  Target: ANGPTL3; (+) strand; PAM type: YTN; PAM sequence: CTA
gattgtgccgtattttaagg

SEQ ID NO: 16554 - DNA, 20 bp, Artificial Sequence
  Description of Artificial Sequence: Synthetic oligonucleotide
  Target: ANGPTL3; (+) strand; PAM type: YTN; PAM sequence: TTG
tgccgtattttaaggtgcag

SEQ ID NO: 16555 - DNA, 20 bp, Artificial Sequence
  Description of Artificial Sequence: Synthetic oligonucleotide
  Target: ANGPTL3; (+) strand; PAM type: YTN; PAM sequence: TTT
taaggtgcagatatctcaat

SEQ ID NO: 16556 - DNA, 20 bp, Artificial Sequence
  Description of Artificial Sequence: Synthetic oligonucleotide
  Target: ANGPTL3; (+) strand; PAM type: YTN; PAM sequence: TTT
aaggtgcagatatctcaatt

SEQ ID NO: 16557 - DNA, 20 bp, Artificial Sequence
  Description of Artificial Sequence: Synthetic oligonucleotide
  Target: ANGPTL3; (+) strand; PAM type: YTN; PAM sequence: TTA
aggtgcagatatctcaattc

SEQ ID NO: 16558 - DNA, 20 bp, Artificial Sequence
  Description of Artificial Sequence: Synthetic oligonucleotide
  Target: ANGPTL3; (+) strand; PAM type: YTN; PAM sequence: CTC
aattcttccacaaatattct

SEQ ID NO: 16559 - DNA, 20 bp, Artificial Sequence
  Description of Artificial Sequence: Synthetic oligonucleotide
  Target: ANGPTL3; (+) strand; PAM type: YTN; PAM sequence: TTC
ttccacaaatattctagtaa

SEQ ID NO: 16560 - DNA, 20 bp, Artificial Sequence
  Description of Artificial Sequence: Synthetic oligonucleotide
  Target: ANGPTL3; (+) strand; PAM type: YTN; PAM sequence: CTT
ccacaaatattctagtaaat

SEQ ID NO: 16561 - DNA, 20 bp, Artificial Sequence
  Description of Artificial Sequence: Synthetic oligonucleotide
  Target: ANGPTL3; (+) strand; PAM type: YTN; PAM sequence: TTC
cacaaatattctagtaaatg

SEQ ID NO: 16562 - DNA, 20 bp, Artificial Sequence
  Description of Artificial Sequence: Synthetic oligonucleotide
  Target: ANGPTL3; (+) strand; PAM type: YTN; PAM sequence: TTC
tagtaaatggcagcttgttc

SEQ ID NO: 16563 - DNA, 20 bp, Artificial Sequence
  Description of Artificial Sequence: Synthetic oligonucleotide
  Target: ANGPTL3; (+) strand; PAM type: YTN; PAM sequence: CTA
gtaaatggcagcttgttcat

SEQ ID NO: 16564 - DNA, 20 bp, Artificial Sequence
  Description of Artificial Sequence: Synthetic oligonucleotide
  Target: ANGPTL3; (+) strand; PAM type: YTN; PAM sequence: CTT
gttcatctgaaaccacacag

SEQ ID NO: 16565 - DNA, 20 bp, Artificial Sequence
  Description of Artificial Sequence: Synthetic oligonucleotide
  Target: ANGPTL3; (+) strand; PAM type: YTN; PAM sequence: TTG
ttcatctgaaaccacacaga

SEQ ID NO: 16566 - DNA, 20 bp, Artificial Sequence
  Description of Artificial Sequence: Synthetic oligonucleotide
  Target: ANGPTL3; (+) strand; PAM type: YTN; PAM sequence: TTC
atctgaaaccacacagaatt

SEQ ID NO: 16567 - DNA, 20 bp, Artificial Sequence
  Description of Artificial Sequence: Synthetic oligonucleotide
  Target: ANGPTL3; (+) strand; PAM type: YTN; PAM sequence: CTG
aaaccacacagaattactgt

SEQ ID NO: 16568 - DNA, 20 bp, Artificial Sequence
  Description of Artificial Sequence: Synthetic oligonucleotide
  Target: ANGPTL3; (+) strand; PAM type: YTN; PAM sequence: TTA
ctgtccatacacctcaaatg

SEQ ID NO: 16569 - DNA, 20 bp, Artificial Sequence
  Description of Artificial Sequence: Synthetic oligonucleotide
  Target: ANGPTL3; (+) strand; PAM type: YTN; PAM sequence: CTG
tccatacacctcaaatggca

SEQ ID NO: 16570 - DNA, 20 bp, Artificial Sequence
  Description of Artificial Sequence: Synthetic oligonucleotide
  Target: ANGPTL3; (+) strand; PAM type: YTN; PAM sequence: CTC
aaatggcacttagtgagaaa

SEQ ID NO: 16571 - DNA, 20 bp, Artificial Sequence
  Description of Artificial Sequence: Synthetic oligonucleotide
  Target: ANGPTL3; (+) strand; PAM type: YTN; PAM sequence: CTT
agtgagaaaatacacagaat

SEQ ID NO: 16572 - DNA, 20 bp, Artificial Sequence
  Description of Artificial Sequence: Synthetic oligonucleotide
  Target: ANGPTL3; (+) strand; PAM type: YTN; PAM sequence: TTA
gtgagaaaatacacagaata

SEQ ID NO: 16573 - DNA, 20 bp, Artificial Sequence
  Description of Artificial Sequence: Synthetic oligonucleotide
  Target: ANGPTL3; (+) strand; PAM type: YTN; PAM sequence: TTC
tgaaaaatagtactaaaagc

SEQ ID NO: 16574 - DNA, 20 bp, Artificial Sequence
  Description of Artificial Sequence: Synthetic oligonucleotide
  Target: ANGPTL3; (+) strand; PAM type: YTN; PAM sequence: CTG
aaaaatagtactaaaagctc

SEQ ID NO: 16575 - DNA, 20 bp, Artificial Sequence
  Description of Artificial Sequence: Synthetic oligonucleotide
  Target: ANGPTL3; (+) strand; PAM type: YTN; PAM sequence: CTA
aaagctccaaaagcatcaaa

SEQ ID NO: 16576 - DNA, 20 bp, Artificial Sequence
  Description of Artificial Sequence: Synthetic oligonucleotide
  Target: ANGPTL3; (+) strand; PAM type: YTN; PAM sequence: CTC
caaaagcatcaaagatagtc

SEQ ID NO: 16577 - DNA, 20 bp, Artificial Sequence
  Description of Artificial Sequence: Synthetic oligonucleotide
  Target: ANGPTL3; (+) strand; PAM type: YTN; PAM sequence: TTT
acctgattttagtgaattac

SEQ ID NO: 16578 - DNA, 20 bp, Artificial Sequence
  Description of Artificial Sequence: Synthetic oligonucleotide
  Target: ANGPTL3; (+) strand; PAM type: YTN; PAM sequence: TTA
cctgattttagtgaattact

SEQ ID NO: 16579 - DNA, 20 bp, Artificial Sequence
  Description of Artificial Sequence: Synthetic oligonucleotide
  Target: ANGPTL3; (+) strand; PAM type: YTN; PAM sequence: CTG
attttagtgaattactgaaa

SEQ ID NO: 16580 - DNA, 20 bp, Artificial Sequence
  Description of Artificial Sequence: Synthetic oligonucleotide
  Target: ANGPTL3; (+) strand; PAM type: YTN; PAM sequence: TTT
tagtgaattactgaaaaatt

SEQ ID NO: 16581 - DNA, 20 bp, Artificial Sequence
  Description of Artificial Sequence: Synthetic oligonucleotide
  Target: ANGPTL3; (+) strand; PAM type: YTN; PAM sequence: TTT
agtgaattactgaaaaattt

SEQ ID NO: 16582 - DNA, 20 bp, Artificial Sequence
  Description of Artificial Sequence: Synthetic oligonucleotide
  Target: ANGPTL3; (+) strand; PAM type: YTN; PAM sequence: TTA
gtgaattactgaaaaatttc

SEQ ID NO: 16583 - DNA, 20 bp, Artificial Sequence
  Description of Artificial Sequence: Synthetic oligonucleotide
  Target: ANGPTL3; (+) strand; PAM type: YTN; PAM sequence: TTA
ctgaaaaatttctatatcaa

SEQ ID NO: 16584 - DNA, 20 bp, Artificial Sequence
  Description of Artificial Sequence: Synthetic oligonucleotide
  Target: ANGPTL3; (+) strand; PAM type: YTN; PAM sequence: CTG
aaaaatttctatatcaagag

SEQ ID NO: 16585 - DNA, 20 bp, Artificial Sequence
  Description of Artificial Sequence: Synthetic oligonucleotide
  Target: ANGPTL3; (+) strand; PAM type: YTN; PAM sequence: TTT
ctatatcaagagtttatttt

SEQ ID NO: 16586 - DNA, 20 bp, Artificial Sequence
  Description of Artificial Sequence: Synthetic oligonucleotide
  Target: ANGPTL3; (+) strand; PAM type: YTN; PAM sequence: TTC
tatatcaagagtttattttg

SEQ ID NO: 16587 - DNA, 20 bp, Artificial Sequence
  Description of Artificial Sequence: Synthetic oligonucleotide
  Target: ANGPTL3; (+) strand; PAM type: YTN; PAM sequence: CTA
tatcaagagtttattttgaa

SEQ ID NO: 16588 - DNA, 20 bp, Artificial Sequence
  Description of Artificial Sequence: Synthetic oligonucleotide
  Target: ANGPTL3; (+) strand; PAM type: YTN; PAM sequence: TTT
attttgaaccagtatgaatt

SEQ ID NO: 16589 - DNA, 20 bp, Artificial Sequence
  Description of Artificial Sequence: Synthetic oligonucleotide
  Target: ANGPTL3; (+) strand; PAM type: YTN; PAM sequence: TTA
ttttgaaccagtatgaattt

SEQ ID NO: 16590 - DNA, 20 bp, Artificial Sequence
  Description of Artificial Sequence: Synthetic oligonucleotide
  Target: ANGPTL3; (+) strand; PAM type: YTN; PAM sequence: TTT
tgaaccagtatgaattttac

SEQ ID NO: 16591 - DNA, 20 bp, Artificial Sequence
  Description of Artificial Sequence: Synthetic oligonucleotide
  Target: ANGPTL3; (+) strand; PAM type: YTN; PAM sequence: TTT
gaaccagtatgaattttact

SEQ ID NO: 16592 - DNA, 20 bp, Artificial Sequence
  Description of Artificial Sequence: Synthetic oligonucleotide
  Target: ANGPTL3; (+) strand; PAM type: YTN; PAM sequence: TTG
aaccagtatgaattttactg

SEQ ID NO: 16593 - DNA, 20 bp, Artificial Sequence
  Description of Artificial Sequence: Synthetic oligonucleotide
  Target: ANGPTL3; (+) strand; PAM type: YTN; PAM sequence: TTT
tactgaaaccaagtacacac

SEQ ID NO: 16594 - DNA, 20 bp, Artificial Sequence
  Description of Artificial Sequence: Synthetic oligonucleotide
  Target: ANGPTL3; (+) strand; PAM type: YTN; PAM sequence: TTT
actgaaaccaagtacacaca

SEQ ID NO: 16595 - DNA, 20 bp, Artificial Sequence
  Description of Artificial Sequence: Synthetic oligonucleotide
  Target: ANGPTL3; (+) strand; PAM type: YTN; PAM sequence: TTA
ctgaaaccaagtacacacat

SEQ ID NO: 16596 - DNA, 20 bp, Artificial Sequence
  Description of Artificial Sequence: Synthetic oligonucleotide
  Target: ANGPTL3; (+) strand; PAM type: YTN; PAM sequence: CTG
aaaccaagtacacacatgtc

SEQ ID NO: 16597 - DNA, 20 bp, Artificial Sequence
  Description of Artificial Sequence: Synthetic oligonucleotide
  Target: ANGPTL3; (+) strand; PAM type: YTN; PAM sequence: CTC
attatgaggtaatctagtgt

SEQ ID NO: 16598 - DNA, 20 bp, Artificial Sequence
  Description of Artificial Sequence: Synthetic oligonucleotide
  Target: ANGPTL3; (+) strand; PAM type: YTN; PAM sequence: TTA
tgaggtaatctagtgtagta

SEQ ID NO: 16599 - DNA, 20 bp, Artificial Sequence
  Description of Artificial Sequence: Synthetic oligonucleotide
  Target: ANGPTL3; (+) strand; PAM type: YTN; PAM sequence: CTA
gtgtagtataatctatttcc

SEQ ID NO: 16600 - DNA, 20 bp, Artificial Sequence
  Description of Artificial Sequence: Synthetic oligonucleotide
  Target: ANGPTL3; (+) strand; PAM type: YTN; PAM sequence: CTA
tttccatacactctgtcatc

SEQ ID NO: 16601 - DNA, 20 bp, Artificial Sequence
  Description of Artificial Sequence: Synthetic oligonucleotide
  Target: ANGPTL3; (+) strand; PAM type: YTN; PAM sequence: TTT
ccatacactctgtcatcctg

SEQ ID NO: 16602 - DNA, 20 bp, Artificial Sequence
  Description of Artificial Sequence: Synthetic oligonucleotide
  Target: ANGPTL3; (+) strand; PAM type: YTN; PAM sequence: TTC
catacactctgtcatcctgg

SEQ ID NO: 16603 - DNA, 20 bp, Artificial Sequence
  Description of Artificial Sequence: Synthetic oligonucleotide
  Target: ANGPTL3; (+) strand; PAM type: YTN; PAM sequence: CTC
tgtcatcctggaatcagcat

SEQ ID NO: 16604 - DNA, 20 bp, Artificial Sequence
  Description of Artificial Sequence: Synthetic oligonucleotide
  Target: ANGPTL3; (+) strand; PAM type: YTN; PAM sequence: CTG
tcatcctggaatcagcatat

SEQ ID NO: 16605 - DNA, 20 bp, Artificial Sequence
  Description of Artificial Sequence: Synthetic oligonucleotide
  Target: ANGPTL3; (+) strand; PAM type: YTN; PAM sequence: CTG
gaatcagcatattttcatgc

SEQ ID NO: 16606 - DNA, 20 bp, Artificial Sequence
  Description of Artificial Sequence: Synthetic oligonucleotide
  Target: ANGPTL3; (+) strand; PAM type: YTN; PAM sequence: TTT
tcatgcttgtatctttactt

SEQ ID NO: 16607 - DNA, 20 bp, Artificial Sequence
  Description of Artificial Sequence: Synthetic oligonucleotide
  Target: ANGPTL3; (+) strand; PAM type: YTN; PAM sequence: TTT
catgcttgtatctttacttc

SEQ ID NO: 16608 - DNA, 20 bp, Artificial Sequence
  Description of Artificial Sequence: Synthetic oligonucleotide
  Target: ANGPTL3; (+) strand; PAM type: YTN; PAM sequence: TTC
atgcttgtatctttacttcc

SEQ ID NO: 16609 - DNA, 20 bp, Artificial Sequence
  Description of Artificial Sequence: Synthetic oligonucleotide
  Target: ANGPTL3; (+) strand; PAM type: YTN; PAM sequence: CTT
gtatctttacttcctaatag

SEQ ID NO: 16610 - DNA, 20 bp, Artificial Sequence
  Description of Artificial Sequence: Synthetic oligonucleotide
  Target: ANGPTL3; (+) strand; PAM type: YTN; PAM sequence: TTG
tatctttacttcctaatagc

SEQ ID NO: 16611 - DNA, 20 bp, Artificial Sequence
  Description of Artificial Sequence: Synthetic oligonucleotide
  Target: ANGPTL3; (+) strand; PAM type: YTN; PAM sequence: CTT
tacttcctaatagcataact

SEQ ID NO: 16612 - DNA, 20 bp, Artificial Sequence
  Description of Artificial Sequence: Synthetic oligonucleotide
  Target: ANGPTL3; (+) strand; PAM type: YTN; PAM sequence: TTT
acttcctaatagcataactc

SEQ ID NO: 16613 - DNA, 20 bp, Artificial Sequence
  Description of Artificial Sequence: Synthetic oligonucleotide
  Target: ANGPTL3; (+) strand; PAM type: YTN; PAM sequence: TTA
cttcctaatagcataactca

SEQ ID NO: 16614 - DNA, 20 bp, Artificial Sequence
  Description of Artificial Sequence: Synthetic oligonucleotide
  Target: ANGPTL3; (+) strand; PAM type: YTN; PAM sequence: CTT
cctaatagcataactcatgg

SEQ ID NO: 16615 - DNA, 20 bp, Artificial Sequence
  Description of Artificial Sequence: Synthetic oligonucleotide
  Target: ANGPTL3; (+) strand; PAM type: YTN; PAM sequence: TTC
ctaatagcataactcatgga

SEQ ID NO: 16616 - DNA, 20 bp, Artificial Sequence
  Description of Artificial Sequence: Synthetic oligonucleotide
  Target: ANGPTL3; (+) strand; PAM type: YTN; PAM sequence: CTA
atagcataactcatggaagt

SEQ ID NO: 16617 - DNA, 20 bp, Artificial Sequence
  Description of Artificial Sequence: Synthetic oligonucleotide
  Target: ANGPTL3; (+) strand; PAM type: YTN; PAM sequence: CTC
atggaagtcaactaactcat

SEQ ID NO: 16618 - DNA, 20 bp, Artificial Sequence
  Description of Artificial Sequence: Synthetic oligonucleotide
  Target: ANGPTL3; (+) strand; PAM type: YTN; PAM sequence: CTA
actcattcattaattttaga

SEQ ID NO: 16619 - DNA, 20 bp, Artificial Sequence
  Description of Artificial Sequence: Synthetic oligonucleotide
  Target: ANGPTL3; (+) strand; PAM type: YTN; PAM sequence: CTC
attcattaattttagaaatg

SEQ ID NO: 16620 - DNA, 20 bp, Artificial Sequence
  Description of Artificial Sequence: Synthetic oligonucleotide
  Target: ANGPTL3; (+) strand; PAM type: YTN; PAM sequence: TTC
attaattttagaaatggtat

SEQ ID NO: 16621 - DNA, 20 bp, Artificial Sequence
  Description of Artificial Sequence: Synthetic oligonucleotide
  Target: ANGPTL3; (+) strand; PAM type: YTN; PAM sequence: TTA
attttagaaatggtattcat

SEQ ID NO: 16622 - DNA, 20 bp, Artificial Sequence
  Description of Artificial Sequence: Synthetic oligonucleotide
  Target: ANGPTL3; (+) strand; PAM type: YTN; PAM sequence: TTT
tagaaatggtattcattaaa

SEQ ID NO: 16623 - DNA, 20 bp, Artificial Sequence
  Description of Artificial Sequence: Synthetic oligonucleotide
  Target: ANGPTL3; (+) strand; PAM type: YTN; PAM sequence: TTT
agaaatggtattcattaaac

SEQ ID NO: 16624 - DNA, 20 bp, Artificial Sequence
  Description of Artificial Sequence: Synthetic oligonucleotide
  Target: ANGPTL3; (+) strand; PAM type: YTN; PAM sequence: TTA
gaaatggtattcattaaaca

SEQ ID NO: 16625 - DNA, 20 bp, Artificial Sequence
  Description of Artificial Sequence: Synthetic oligonucleotide
  Target: ANGPTL3; (+) strand; PAM type: YTN; PAM sequence: TTC
attaaacaacacttattgag

SEQ ID NO: 16626 - DNA, 20 bp, Artificial Sequence
  Description of Artificial Sequence: Synthetic oligonucleotide
  Target: ANGPTL3; (+) strand; PAM type: YTN; PAM sequence: TTA
aacaacacttattgagcatc

SEQ ID NO: 16627 - DNA, 20 bp, Artificial Sequence
  Description of Artificial Sequence: Synthetic oligonucleotide
  Target: ANGPTL3; (+) strand; PAM type: YTN; PAM sequence: CTT
attgagcatctactatttgt

SEQ ID NO: 16628 - DNA, 20 bp, Artificial Sequence
  Description of Artificial Sequence: Synthetic oligonucleotide
  Target: ANGPTL3; (+) strand; PAM type: YTN; PAM sequence: TTA
ttgagcatctactatttgtc

SEQ ID NO: 16629 - DNA, 20 bp, Artificial Sequence
  Description of Artificial Sequence: Synthetic oligonucleotide
  Target: ANGPTL3; (+) strand; PAM type: YTN; PAM sequence: TTG
agcatctactatttgtctcc

SEQ ID NO: 16630 - DNA, 20 bp, Artificial Sequence
  Description of Artificial Sequence: Synthetic oligonucleotide
  Target: ANGPTL3; (+) strand; PAM type: YTN; PAM sequence: CTA
ctatttgtctcctttaaaaa

SEQ ID NO: 16631 - DNA, 20 bp, Artificial Sequence
  Description of Artificial Sequence: Synthetic oligonucleotide
  Target: ANGPTL3; (+) strand; PAM type: YTN; PAM sequence: CTA
tttgtctcctttaaaaaaca

SEQ ID NO: 16632 - DNA, 20 bp, Artificial Sequence
  Description of Artificial Sequence: Synthetic oligonucleotide
  Target: ANGPTL3; (+) strand; PAM type: YTN; PAM sequence: TTT
gtctcctttaaaaaacatat

SEQ ID NO: 16633 - DNA, 20 bp, Artificial Sequence
  Description of Artificial Sequence: Synthetic oligonucleotide
  Target: ANGPTL3; (+) strand; PAM type: YTN; PAM sequence: TTG
tctcctttaaaaaacatatt

SEQ ID NO: 16634 - DNA, 20 bp, Artificial Sequence
  Description of Artificial Sequence: Synthetic oligonucleotide
  Target: ANGPTL3; (+) strand; PAM type: YTN; PAM sequence: CTC
ctttaaaaaacatattccaa

SEQ ID NO: 16635 - DNA, 20 bp, Artificial Sequence
  Description of Artificial Sequence: Synthetic oligonucleotide
  Target: ANGPTL3; (+) strand; PAM type: YTN; PAM sequence: CTT
taaaaaacatattccaaatt

SEQ ID NO: 16636 - DNA, 20 bp, Artificial Sequence
  Description of Artificial Sequence: Synthetic oligonucleotide
  Target: ANGPTL3; (+) strand; PAM type: YTN; PAM sequence: TTT
aaaaaacatattccaaattt

SEQ ID NO: 16637 - DNA, 20 bp, Artificial Sequence
  Description of Artificial Sequence: Synthetic oligonucleotide
  Target: ANGPTL3; (+) strand; PAM type: YTN; PAM sequence: TTA
aaaaacatattccaaatttg

SEQ ID NO: 16638 - DNA, 20 bp, Artificial Sequence
  Description of Artificial Sequence: Synthetic oligonucleotide
  Target: ANGPTL3; (+) strand; PAM type: YTN; PAM sequence: TTC
caaatttgtactcatatata

SEQ ID NO: 16639 - DNA, 20 bp, Artificial Sequence
  Description of Artificial Sequence: Synthetic oligonucleotide
  Target: ANGPTL3; (+) strand; PAM type: YTN; PAM sequence: TTT
gtactcatatatactctacc

SEQ ID NO: 16640 - DNA, 20 bp, Artificial Sequence
  Description of Artificial Sequence: Synthetic oligonucleotide
  Target: ANGPTL3; (+) strand; PAM type: YTN; PAM sequence: TTG
tactcatatatactctacct

SEQ ID NO: 16641 - DNA, 20 bp, Artificial Sequence
  Description of Artificial Sequence: Synthetic oligonucleotide
  Target: ANGPTL3; (+) strand; PAM type: YTN; PAM sequence: CTC
atatatactctaccttctgc

SEQ ID NO: 16642 - DNA, 20 bp, Artificial Sequence
  Description of Artificial Sequence: Synthetic oligonucleotide
  Target: ANGPTL3; (+) strand; PAM type: YTN; PAM sequence: CTC
taccttctgctgtaggataa

SEQ ID NO: 16643 - DNA, 20 bp, Artificial Sequence
  Description of Artificial Sequence: Synthetic oligonucleotide
  Target: ANGPTL3; (+) strand; PAM type: YTN; PAM sequence: CTA
ccttctgctgtaggataatc

SEQ ID NO: 16644 - DNA, 20 bp, Artificial Sequence
  Description of Artificial Sequence: Synthetic oligonucleotide
  Target: ANGPTL3; (+) strand; PAM type: YTN; PAM sequence: CTT
ctgctgtaggataatcaaat

SEQ ID NO: 16645 - DNA, 20 bp, Artificial Sequence
  Description of Artificial Sequence: Synthetic oligonucleotide
  Target: ANGPTL3; (+) strand; PAM type: YTN; PAM sequence: TTC
tgctgtaggataatcaaatt

SEQ ID NO: 16646 - DNA, 20 bp, Artificial Sequence
  Description of Artificial Sequence: Synthetic oligonucleotide
  Target: ANGPTL3; (+) strand; PAM type: YTN; PAM sequence: CTG
ctgtaggataatcaaatttc

SEQ ID NO: 16647 - DNA, 20 bp, Artificial Sequence
  Description of Artificial Sequence: Synthetic oligonucleotide
  Target: ANGPTL3; (+) strand; PAM type: YTN; PAM sequence: CTG
taggataatcaaatttcctt

SEQ ID NO: 16648 - DNA, 20 bp, Artificial Sequence
  Description of Artificial Sequence: Synthetic oligonucleotide
  Target: ANGPTL3; (+) strand; PAM type: YTN; PAM sequence: TTT
ccttgtgatttttttcccca

SEQ ID NO: 16649 - DNA, 20 bp, Artificial Sequence
  Description of Artificial Sequence: Synthetic oligonucleotide
  Target: ANGPTL3; (+) strand; PAM type: YTN; PAM sequence: TTC
cttgtgatttttttccccat

SEQ ID NO: 16650 - DNA, 20 bp, Artificial Sequence
  Description of Artificial Sequence: Synthetic oligonucleotide
  Target: ANGPTL3; (+) strand; PAM type: YTN; PAM sequence: CTT
gtgatttttttccccatcac

SEQ ID NO: 16651 - DNA, 20 bp, Artificial Sequence
  Description of Artificial Sequence: Synthetic oligonucleotide
  Target: ANGPTL3; (+) strand; PAM type: YTN; PAM sequence: TTG
tgatttttttccccatcact

SEQ ID NO: 16652 - DNA, 20 bp, Artificial Sequence
  Description of Artificial Sequence: Synthetic oligonucleotide
  Target: ANGPTL3; (+) strand; PAM type: YTN; PAM sequence: TTT
ttttccccatcactaacagc

SEQ ID NO: 16653 - DNA, 20 bp, Artificial Sequence
  Description of Artificial Sequence: Synthetic oligonucleotide
  Target: ANGPTL3; (+) strand; PAM type: YTN; PAM sequence: TTT
tttccccatcactaacagcc

SEQ ID NO: 16654 - DNA, 20 bp, Artificial Sequence
  Description of Artificial Sequence: Synthetic oligonucleotide
  Target: ANGPTL3; (+) strand; PAM type: YTN; PAM sequence: TTT
ttccccatcactaacagcca

SEQ ID NO: 16655 - DNA, 20 bp, Artificial Sequence
  Description of Artificial Sequence: Synthetic oligonucleotide
  Target: ANGPTL3; (+) strand; PAM type: YTN; PAM sequence: TTT
tccccatcactaacagccat

SEQ ID NO: 16656 - DNA, 20 bp, Artificial Sequence
  Description of Artificial Sequence: Synthetic oligonucleotide
  Target: ANGPTL3; (+) strand; PAM type: YTN; PAM sequence: TTT
ccccatcactaacagccata

SEQ ID NO: 16657 - DNA, 20 bp, Artificial Sequence
  Description of Artificial Sequence: Synthetic oligonucleotide
  Target: ANGPTL3; (+) strand; PAM type: YTN; PAM sequence: TTC
cccatcactaacagccataa

SEQ ID NO: 16658 - DNA, 20 bp, Artificial Sequence
  Description of Artificial Sequence: Synthetic oligonucleotide
  Target: ANGPTL3; (+) strand; PAM type: YTN; PAM sequence: CTA
acagccataaactctgcact

SEQ ID NO: 16659 - DNA, 20 bp, Artificial Sequence
  Description of Artificial Sequence: Synthetic oligonucleotide
  Target: ANGPTL3; (+) strand; PAM type: YTN; PAM sequence: CTC
tgcacttatgtatgtactac

SEQ ID NO: 16660 - DNA, 20 bp, Artificial Sequence
  Description of Artificial Sequence: Synthetic oligonucleotide
  Target: ANGPTL3; (+) strand; PAM type: YTN; PAM sequence: CTG
cacttatgtatgtactactg

SEQ ID NO: 16661 - DNA, 20 bp, Artificial Sequence
  Description of Artificial Sequence: Synthetic oligonucleotide
  Target: ANGPTL3; (+) strand; PAM type: YTN; PAM sequence: CTT
atgtatgtactactgagtga

SEQ ID NO: 16662 - DNA, 20 bp, Artificial Sequence
  Description of Artificial Sequence: Synthetic oligonucleotide
  Target: ANGPTL3; (+) strand; PAM type: YTN; PAM sequence: TTA
tgtatgtactactgagtgat

SEQ ID NO: 16663 - DNA, 20 bp, Artificial Sequence
  Description of Artificial Sequence: Synthetic oligonucleotide
  Target: ANGPTL3; (+) strand; PAM type: YTN; PAM sequence: CTA
ctgagtgattatcaaacaca

SEQ ID NO: 16664 - DNA, 20 bp, Artificial Sequence
  Description of Artificial Sequence: Synthetic oligonucleotide
  Target: ANGPTL3; (+) strand; PAM type: YTN; PAM sequence: CTG
agtgattatcaaacacagca

SEQ ID NO: 16665 - DNA, 20 bp, Artificial Sequence
  Description of Artificial Sequence: Synthetic oligonucleotide
  Target: ANGPTL3; (+) strand; PAM type: YTN; PAM sequence: TTA
tcaaacacagcagttttaaa

SEQ ID NO: 16666 - DNA, 20 bp, Artificial Sequence
  Description of Artificial Sequence: Synthetic oligonucleotide
  Target: ANGPTL3; (+) strand; PAM type: YTN; PAM sequence: TTT
taaaaatgaaaagaaagtga

SEQ ID NO: 16667 - DNA, 20 bp, Artificial Sequence
  Description of Artificial Sequence: Synthetic oligonucleotide
  Target: ANGPTL3; (+) strand; PAM type: YTN; PAM sequence: TTT
aaaaatgaaaagaaagtgac

SEQ ID NO: 16668 - DNA, 20 bp, Artificial Sequence
  Description of Artificial Sequence: Synthetic oligonucleotide
  Target: ANGPTL3; (+) strand; PAM type: YTN; PAM sequence: TTA
aaaatgaaaagaaagtgacc

SEQ ID NO: 16669 - DNA, 20 bp, Artificial Sequence
  Description of Artificial Sequence: Synthetic oligonucleotide
  Target: ANGPTL3; (+) strand; PAM type: YTN; PAM sequence: TTG
gcccttttatcaaagtccaa

SEQ ID NO: 16670 - DNA, 20 bp, Artificial Sequence
  Description of Artificial Sequence: Synthetic oligonucleotide
  Target: ANGPTL3; (+) strand; PAM type: YTN; PAM sequence: CTT
ttatcaaagtccaaagtatt

SEQ ID NO: 16671 - DNA, 20 bp, Artificial Sequence
  Description of Artificial Sequence: Synthetic oligonucleotide
  Target: ANGPTL3; (+) strand; PAM type: YTN; PAM sequence: TTT
tatcaaagtccaaagtatta

SEQ ID NO: 16672 - DNA, 20 bp, Artificial Sequence
  Description of Artificial Sequence: Synthetic oligonucleotide
  Target: ANGPTL3; (+) strand; PAM type: YTN; PAM sequence: TTT
atcaaagtccaaagtattat

SEQ ID NO: 16673 - DNA, 20 bp, Artificial Sequence
  Description of Artificial Sequence: Synthetic oligonucleotide
  Target: ANGPTL3; (+) strand; PAM type: YTN; PAM sequence: TTA
tcaaagtccaaagtattatc

SEQ ID NO: 16674 - DNA, 20 bp, Artificial Sequence
  Description of Artificial Sequence: Synthetic oligonucleotide
  Target: ANGPTL3; (+) strand; PAM type: YTN; PAM sequence: TTA
tcatggcaaatcaactaggg

SEQ ID NO: 16675 - DNA, 20 bp, Artificial Sequence
  Description of Artificial Sequence: Synthetic oligonucleotide
  Target: ANGPTL3; (+) strand; PAM type: YTN; PAM sequence: CTA
gggtaaaattacttaactgg

SEQ ID NO: 16676 - DNA, 20 bp, Artificial Sequence
  Description of Artificial Sequence: Synthetic oligonucleotide
  Target: ANGPTL3; (+) strand; PAM type: YTN; PAM sequence: TTA
cttaactggtgcacagttca

SEQ ID NO: 16677 - DNA, 20 bp, Artificial Sequence
  Description of Artificial Sequence: Synthetic oligonucleotide
  Target: ANGPTL3; (+) strand; PAM type: YTN; PAM sequence: CTT
aactggtgcacagttcaagg

SEQ ID NO: 16678 - DNA, 20 bp, Artificial Sequence
  Description of Artificial Sequence: Synthetic oligonucleotide
  Target: ANGPTL3; (+) strand; PAM type: YTN; PAM sequence: TTA
actggtgcacagttcaaggt

SEQ ID NO: 16679 - DNA, 20 bp, Artificial Sequence
  Description of Artificial Sequence: Synthetic oligonucleotide
  Target: ANGPTL3; (+) strand; PAM type: YTN; PAM sequence: CTG
gtgcacagttcaaggtcatg

SEQ ID NO: 16680 - DNA, 20 bp, Artificial Sequence
  Description of Artificial Sequence: Synthetic oligonucleotide
  Target: ANGPTL3; (+) strand; PAM type: YTN; PAM sequence: TTC
aaggtcatgaaagtagcact

SEQ ID NO: 16681 - DNA, 20 bp, Artificial Sequence
  Description of Artificial Sequence: Synthetic oligonucleotide
  Target: ANGPTL3; (+) strand; PAM type: YTN; PAM sequence: CTA
acaatcctctattataaccc

SEQ ID NO: 16682 - DNA, 20 bp, Artificial Sequence
  Description of Artificial Sequence: Synthetic oligonucleotide
  Target: ANGPTL3; (+) strand; PAM type: YTN; PAM sequence: CTC
tattataacccttaataaaa

SEQ ID NO: 16683 - DNA, 20 bp, Artificial Sequence
  Description of Artificial Sequence: Synthetic oligonucleotide
  Target: ANGPTL3; (+) strand; PAM type: YTN; PAM sequence: CTA
ttataacccttaataaaatg

SEQ ID NO: 16684 - DNA, 20 bp, Artificial Sequence
  Description of Artificial Sequence: Synthetic oligonucleotide
  Target: ANGPTL3; (+) strand; PAM type: YTN; PAM sequence: TTA
taacccttaataaaatgagg

SEQ ID NO: 16685 - DNA, 20 bp, Artificial Sequence
  Description of Artificial Sequence: Synthetic oligonucleotide
  Target: ANGPTL3; (+) strand; PAM type: YTN; PAM sequence: CTT
aataaaatgaggttttaatg

SEQ ID NO: 16686 - DNA, 20 bp, Artificial Sequence
  Description of Artificial Sequence: Synthetic oligonucleotide
  Target: ANGPTL3; (+) strand; PAM type: YTN; PAM sequence: TTA
ataaaatgaggttttaatga

SEQ ID NO: 16687 - DNA, 20 bp, Artificial Sequence
  Description of Artificial Sequence: Synthetic oligonucleotide
  Target: ANGPTL3; (+) strand; PAM type: YTN; PAM sequence: TTT
taatgacattttaggaaata

SEQ ID NO: 16688 - DNA, 20 bp, Artificial Sequence
  Description of Artificial Sequence: Synthetic oligonucleotide
  Target: ANGPTL3; (+) strand; PAM type: YTN; PAM sequence: TTT
aatgacattttaggaaatat

SEQ ID NO: 16689 - DNA, 20 bp, Artificial Sequence
  Description of Artificial Sequence: Synthetic oligonucleotide
  Target: ANGPTL3; (+) strand; PAM type: YTN; PAM sequence: TTA
atgacattttaggaaatata

SEQ ID NO: 16690 - DNA, 20 bp, Artificial Sequence
  Description of Artificial Sequence: Synthetic oligonucleotide
  Target: ANGPTL3; (+) strand; PAM type: YTN; PAM sequence: TTT
taggaaatataaaataaact

SEQ ID NO: 16691 - DNA, 20 bp, Artificial Sequence
  Description of Artificial Sequence: Synthetic oligonucleotide
  Target: ANGPTL3; (+) strand; PAM type: YTN; PAM sequence: TTT
aggaaatataaaataaactt

SEQ ID NO: 16692 - DNA, 20 bp, Artificial Sequence
  Description of Artificial Sequence: Synthetic oligonucleotide
  Target: ANGPTL3; (+) strand; PAM type: YTN; PAM sequence: TTA
ggaaatataaaataaactta

SEQ ID NO: 16693 - DNA, 20 bp, Artificial Sequence
  Description of Artificial Sequence: Synthetic oligonucleotide
  Target: ANGPTL3; (+) strand; PAM type: YTN; PAM sequence: CTT
aagaattctatctaaaatac

SEQ ID NO: 16694 - DNA, 20 bp, Artificial Sequence
  Description of Artificial Sequence: Synthetic oligonucleotide
  Target: ANGPTL3; (+) strand; PAM type: YTN; PAM sequence: TTA
agaattctatctaaaataca

SEQ ID NO: 16695 - DNA, 20 bp, Artificial Sequence
  Description of Artificial Sequence: Synthetic oligonucleotide
  Target: ANGPTL3; (+) strand; PAM type: YTN; PAM sequence: TTC
tatctaaaatacaaaggctg

SEQ ID NO: 16696 - DNA, 20 bp, Artificial Sequence
  Description of Artificial Sequence: Synthetic oligonucleotide
  Target: ANGPTL3; (+) strand; PAM type: YTN; PAM sequence: CTA
tctaaaatacaaaggctgtt

SEQ ID NO: 16697 - DNA, 20 bp, Artificial Sequence
  Description of Artificial Sequence: Synthetic oligonucleotide
  Target: ANGPTL3; (+) strand; PAM type: YTN; PAM sequence: CTA
aaatacaaaggctgtttttc

SEQ ID NO: 16698 - DNA, 20 bp, Artificial Sequence
  Description of Artificial Sequence: Synthetic oligonucleotide
  Target: ANGPTL3; (+) strand; PAM type: YTN; PAM sequence: CTG
tttttcctaaattcatgttt

SEQ ID NO: 16699 - DNA, 20 bp, Artificial Sequence
  Description of Artificial Sequence: Synthetic oligonucleotide
  Target: ANGPTL3; (+) strand; PAM type: YTN; PAM sequence: TTT
ttcctaaattcatgtttagt

SEQ ID NO: 16700 - DNA, 20 bp, Artificial Sequence
  Description of Artificial Sequence: Synthetic oligonucleotide
  Target: ANGPTL3; (+) strand; PAM type: YTN; PAM sequence: TTT
tcctaaattcatgtttagtc

SEQ ID NO: 16701 - DNA, 20 bp, Artificial Sequence
  Description of Artificial Sequence: Synthetic oligonucleotide
  Target: ANGPTL3; (+) strand; PAM type: YTN; PAM sequence: TTT
cctaaattcatgtttagtcc

SEQ ID NO: 16702 - DNA, 20 bp, Artificial Sequence
  Description of Artificial Sequence: Synthetic oligonucleotide
  Target: ANGPTL3; (+) strand; PAM type: YTN; PAM sequence: TTC
ctaaattcatgtttagtcct

SEQ ID NO: 16703 - DNA, 20 bp, Artificial Sequence
  Description of Artificial Sequence: Synthetic oligonucleotide
  Target: ANGPTL3; (+) strand; PAM type: YTN; PAM sequence: CTA
aattcatgtttagtcctaag

SEQ ID NO: 16704 - DNA, 20 bp, Artificial Sequence
  Description of Artificial Sequence: Synthetic oligonucleotide
  Target: ANGPTL3; (+) strand; PAM type: YTN; PAM sequence: TTC
atgtttagtcctaagaacag

SEQ ID NO: 16705 - DNA, 20 bp, Artificial Sequence
  Description of Artificial Sequence: Synthetic oligonucleotide
  Target: ANGPTL3; (+) strand; PAM type: YTN; PAM sequence: TTT
agtcctaagaacagtcatac

SEQ ID NO: 16706 - DNA, 20 bp, Artificial Sequence
  Description of Artificial Sequence: Synthetic oligonucleotide
  Target: ANGPTL3; (+) strand; PAM type: YTN; PAM sequence: TTA
gtcctaagaacagtcataca

SEQ ID NO: 16707 - DNA, 20 bp, Artificial Sequence
  Description of Artificial Sequence: Synthetic oligonucleotide
  Target: ANGPTL3; (+) strand; PAM type: YTN; PAM sequence: CTA
agaacagtcatacatctaat

SEQ ID NO: 16708 - DNA, 20 bp, Artificial Sequence
  Description of Artificial Sequence: Synthetic oligonucleotide
  Target: ANGPTL3; (+) strand; PAM type: YTN; PAM sequence: CTA
ataaaatgactgggtatata

SEQ ID NO: 16709 - DNA, 20 bp, Artificial Sequence
  Description of Artificial Sequence: Synthetic oligonucleotide
  Target: ANGPTL3; (+) strand; PAM type: YTN; PAM sequence: CTG
ggtatataatttgaaagagc

SEQ ID NO: 16710 - DNA, 20 bp, Artificial Sequence
  Description of Artificial Sequence: Synthetic oligonucleotide
  Target: ANGPTL3; (+) strand; PAM type: YTN; PAM sequence: TTT
gaaagagcaataaattacta

SEQ ID NO: 16711 - DNA, 20 bp, Artificial Sequence
  Description of Artificial Sequence: Synthetic oligonucleotide
  Target: ANGPTL3; (+) strand; PAM type: YTN; PAM sequence: TTG
aaagagcaataaattactac

SEQ ID NO: 16712 - DNA, 20 bp, Artificial Sequence
  Description of Artificial Sequence: Synthetic oligonucleotide
  Target: ANGPTL3; (+) strand; PAM type: YTN; PAM sequence: TTA
ctaccttgaagatgtaaggt

SEQ ID NO: 16713 - DNA, 20 bp, Artificial Sequence
  Description of Artificial Sequence: Synthetic oligonucleotide
  Target: ANGPTL3; (+) strand; PAM type: YTN; PAM sequence: CTA
ccttgaagatgtaaggttgt

SEQ ID NO: 16714 - DNA, 20 bp, Artificial Sequence
  Description of Artificial Sequence: Synthetic oligonucleotide
  Target: ANGPTL3; (+) strand; PAM type: YTN; PAM sequence: CTT
gaagatgtaaggttgtagct

SEQ ID NO: 16715 - DNA, 20 bp, Artificial Sequence
  Description of Artificial Sequence: Synthetic oligonucleotide
  Target: ANGPTL3; (+) strand; PAM type: YTN; PAM sequence: TTG
aagatgtaaggttgtagcta

SEQ ID NO: 16716 - DNA, 20 bp, Artificial Sequence
  Description of Artificial Sequence: Synthetic oligonucleotide
  Target: ANGPTL3; (+) strand; PAM type: YTN; PAM sequence: TTG
tagctatttatcttaaaata

SEQ ID NO: 16717 - DNA, 20 bp, Artificial Sequence
  Description of Artificial Sequence: Synthetic oligonucleotide
  Target: ANGPTL3; (+) strand; PAM type: YTN; PAM sequence: CTA
tttatcttaaaatacacagt

SEQ ID NO: 16718 - DNA, 20 bp, Artificial Sequence
  Description of Artificial Sequence: Synthetic oligonucleotide
  Target: ANGPTL3; (+) strand; PAM type: YTN; PAM sequence: TTT
atcttaaaatacacagtcaa

SEQ ID NO: 16719 - DNA, 20 bp, Artificial Sequence
  Description of Artificial Sequence: Synthetic oligonucleotide
  Target: ANGPTL3; (+) strand; PAM type: YTN; PAM sequence: TTA
tcttaaaatacacagtcaaa

SEQ ID NO: 16720 - DNA, 20 bp, Artificial Sequence
  Description of Artificial Sequence: Synthetic oligonucleotide
  Target: ANGPTL3; (+) strand; PAM type: YTN; PAM sequence: CTT
aaaatacacagtcaaacctc

SEQ ID NO: 16721 - DNA, 20 bp, Artificial Sequence
  Description of Artificial Sequence: Synthetic oligonucleotide
  Target: ANGPTL3; (+) strand; PAM type: YTN; PAM sequence: TTA
aaatacacagtcaaacctca

SEQ ID NO: 16722 - DNA, 20 bp, Artificial Sequence
  Description of Artificial Sequence: Synthetic oligonucleotide
  Target: ANGPTL3; (+) strand; PAM type: YTN; PAM sequence: CTC
agtttccacacccaatagat

SEQ ID NO: 16723 - DNA, 20 bp, Artificial Sequence
  Description of Artificial Sequence: Synthetic oligonucleotide
  Target: ANGPTL3; (+) strand; PAM type: YTN; PAM sequence: TTT
ccacacccaatagatgggaa

SEQ ID NO: 16724 - DNA, 20 bp, Artificial Sequence
  Description of Artificial Sequence: Synthetic oligonucleotide
  Target: ANGPTL3; (+) strand; PAM type: YTN; PAM sequence: TTC
cacacccaatagatgggaat

SEQ ID NO: 16725 - DNA, 20 bp, Artificial Sequence
  Description of Artificial Sequence: Synthetic oligonucleotide
  Target: ANGPTL3; (+) strand; PAM type: YTN; PAM sequence: CTG
tcaaatctattaatacttca

SEQ ID NO: 16726 - DNA, 20 bp, Artificial Sequence
  Description of Artificial Sequence: Synthetic oligonucleotide
  Target: ANGPTL3; (+) strand; PAM type: YTN; PAM sequence: CTA
ttaatacttcatgggattgt

SEQ ID NO: 16727 - DNA, 20 bp, Artificial Sequence
  Description of Artificial Sequence: Synthetic oligonucleotide
  Target: ANGPTL3; (+) strand; PAM type: YTN; PAM sequence: TTA
atacttcatgggattgtaat

SEQ ID NO: 16728 - DNA, 20 bp, Artificial Sequence
  Description of Artificial Sequence: Synthetic oligonucleotide
  Target: ANGPTL3; (+) strand; PAM type: YTN; PAM sequence: CTT
catgggattgtaatcatcaa

SEQ ID NO: 16729 - DNA, 20 bp, Artificial Sequence
  Description of Artificial Sequence: Synthetic oligonucleotide
  Target: ANGPTL3; (+) strand; PAM type: YTN; PAM sequence: TTC
atgggattgtaatcatcaag

SEQ ID NO: 16730 - DNA, 20 bp, Artificial Sequence
  Description of Artificial Sequence: Synthetic oligonucleotide
  Target: ANGPTL3; (+) strand; PAM type: YTN; PAM sequence: TTG
taatcatcaagccagataat

SEQ ID NO: 16731 - DNA, 20 bp, Artificial Sequence
  Description of Artificial Sequence: Synthetic oligonucleotide
  Target: ANGPTL3; (+) strand; PAM type: YTN; PAM sequence: TTT
gaatagctttatgaactata

SEQ ID NO: 16732 - DNA, 20 bp, Artificial Sequence
  Description of Artificial Sequence: Synthetic oligonucleotide
  Target: ANGPTL3; (+) strand; PAM type: YTN; PAM sequence: TTG
aatagctttatgaactataa

SEQ ID NO: 16733 - DNA, 20 bp, Artificial Sequence
  Description of Artificial Sequence: Synthetic oligonucleotide
  Target: ANGPTL3; (+) strand; PAM type: YTN; PAM sequence: CTT
tatgaactataaagttctaa

SEQ ID NO: 16734 - DNA, 20 bp, Artificial Sequence
  Description of Artificial Sequence: Synthetic oligonucleotide
  Target: ANGPTL3; (+) strand; PAM type: YTN; PAM sequence: TTT
atgaactataaagttctaaa

SEQ ID NO: 16735 - DNA, 20 bp, Artificial Sequence
  Description of Artificial Sequence: Synthetic oligonucleotide
  Target: ANGPTL3; (+) strand; PAM type: YTN; PAM sequence: TTA
tgaactataaagttctaaac

SEQ ID NO: 16736 - DNA, 20 bp, Artificial Sequence
  Description of Artificial Sequence: Synthetic oligonucleotide
  Target: ANGPTL3; (+) strand; PAM type: YTN; PAM sequence: CTA
taaagttctaaacaaatgta

SEQ ID NO: 16737 - DNA, 20 bp, Artificial Sequence
  Description of Artificial Sequence: Synthetic oligonucleotide
  Target: ANGPTL3; (+) strand; PAM type: YTN; PAM sequence: TTC
taaacaaatgtatatacttt

SEQ ID NO: 16738 - DNA, 20 bp, Artificial Sequence
  Description of Artificial Sequence: Synthetic oligonucleotide
  Target: ANGPTL3; (+) strand; PAM type: YTN; PAM sequence: CTA
aacaaatgtatatacttttt

SEQ ID NO: 16739 - DNA, 20 bp, Artificial Sequence
  Description of Artificial Sequence: Synthetic oligonucleotide
  Target: ANGPTL3; (+) strand; PAM type: YTN; PAM sequence: CTT
tttaaaaacaggttcttccg

SEQ ID NO: 16740 - DNA, 20 bp, Artificial Sequence
  Description of Artificial Sequence: Synthetic oligonucleotide
  Target: ANGPTL3; (+) strand; PAM type: YTN; PAM sequence: TTT
ttaaaaacaggttcttccgt

SEQ ID NO: 16741 - DNA, 20 bp, Artificial Sequence
  Description of Artificial Sequence: Synthetic oligonucleotide
  Target: ANGPTL3; (+) strand; PAM type: YTN; PAM sequence: TTT
taaaaacaggttcttccgtg

SEQ ID NO: 16742 - DNA, 20 bp, Artificial Sequence
  Description of Artificial Sequence: Synthetic oligonucleotide
  Target: ANGPTL3; (+) strand; PAM type: YTN; PAM sequence: TTT
aaaaacaggttcttccgtgt

SEQ ID NO: 16743 - DNA, 20 bp, Artificial Sequence
  Description of Artificial Sequence: Synthetic oligonucleotide
  Target: ANGPTL3; (+) strand; PAM type: YTN; PAM sequence: TTA
aaaacaggttcttccgtgtc

SEQ ID NO: 16744 - DNA, 20 bp, Artificial Sequence
  Description of Artificial Sequence: Synthetic oligonucleotide
  Target: ANGPTL3; (+) strand; PAM type: YTN; PAM sequence: TTC
ttccgtgtcatttttcacat

SEQ ID NO: 16745 - DNA, 20 bp, Artificial Sequence
  Description of Artificial Sequence: Synthetic oligonucleotide
  Target: ANGPTL3; (+) strand; PAM type: YTN; PAM sequence: CTT
ccgtgtcatttttcacattc

SEQ ID NO: 16746 - DNA, 20 bp, Artificial Sequence
  Description of Artificial Sequence: Synthetic oligonucleotide
  Target: ANGPTL3; (+) strand; PAM type: YTN; PAM sequence: TTC
cgtgtcatttttcacattcc

SEQ ID NO: 16747 - DNA, 20 bp, Artificial Sequence
  Description of Artificial Sequence: Synthetic oligonucleotide
  Target: ANGPTL3; (+) strand; PAM type: YTN; PAM sequence: TTT
ttcacattcctttaagtaaa

SEQ ID NO: 16748 - DNA, 20 bp, Artificial Sequence
  Description of Artificial Sequence: Synthetic oligonucleotide
  Target: ANGPTL3; (+) strand; PAM type: YTN; PAM sequence: TTT
tcacattcctttaagtaaat

SEQ ID NO: 16749 - DNA, 20 bp, Artificial Sequence
  Description of Artificial Sequence: Synthetic oligonucleotide
  Target: ANGPTL3; (+) strand; PAM type: YTN; PAM sequence: TTT
cacattcctttaagtaaata

SEQ ID NO: 16750 - DNA, 20 bp, Artificial Sequence
  Description of Artificial Sequence: Synthetic oligonucleotide
  Target: ANGPTL3; (+) strand; PAM type: YTN; PAM sequence: TTC
acattcctttaagtaaataa

SEQ ID NO: 16751 - DNA, 20 bp, Artificial Sequence
  Description of Artificial Sequence: Synthetic oligonucleotide
  Target: ANGPTL3; (+) strand; PAM type: YTN; PAM sequence: TTC
ctttaagtaaataatctcta

SEQ ID NO: 16752 - DNA, 20 bp, Artificial Sequence
  Description of Artificial Sequence: Synthetic oligonucleotide
  Target: ANGPTL3; (+) strand; PAM type: YTN; PAM sequence: CTT
taagtaaataatctctacaa

SEQ ID NO: 16753 - DNA, 20 bp, Artificial Sequence
  Description of Artificial Sequence: Synthetic oligonucleotide
  Target: ANGPTL3; (+) strand; PAM type: YTN; PAM sequence: TTT
aagtaaataatctctacaaa

SEQ ID NO: 16754 - DNA, 20 bp, Artificial Sequence
  Description of Artificial Sequence: Synthetic oligonucleotide
  Target: ANGPTL3; (+) strand; PAM type: YTN; PAM sequence: TTA
agtaaataatctctacaaac

SEQ ID NO: 16755 - DNA, 20 bp, Artificial Sequence
  Description of Artificial Sequence: Synthetic oligonucleotide
  Target: ANGPTL3; (+) strand; PAM type: YTN; PAM sequence: CTC
tacaaacgcttcctaactga

SEQ ID NO: 16756 - DNA, 20 bp, Artificial Sequence
  Description of Artificial Sequence: Synthetic oligonucleotide
  Target: ANGPTL3; (+) strand; PAM type: YTN; PAM sequence: CTA
caaacgcttcctaactgaac

SEQ ID NO: 16757 - DNA, 20 bp, Artificial Sequence
  Description of Artificial Sequence: Synthetic oligonucleotide
  Target: ANGPTL3; (+) strand; PAM type: YTN; PAM sequence: CTT
cctaactgaacatattataa

SEQ ID NO: 16758 - DNA, 20 bp, Artificial Sequence
  Description of Artificial Sequence: Synthetic oligonucleotide
  Target: ANGPTL3; (+) strand; PAM type: YTN; PAM sequence: TTC
ctaactgaacatattataat

SEQ ID NO: 16759 - DNA, 20 bp, Artificial Sequence
  Description of Artificial Sequence: Synthetic oligonucleotide
  Target: ANGPTL3; (+) strand; PAM type: YTN; PAM sequence: CTA
actgaacatattataattct

SEQ ID NO: 16760 - DNA, 20 bp, Artificial Sequence
  Description of Artificial Sequence: Synthetic oligonucleotide
  Target: ANGPTL3; (+) strand; PAM type: YTN; PAM sequence: CTG
aacatattataattctcagg

SEQ ID NO: 16761 - DNA, 20 bp, Artificial Sequence
  Description of Artificial Sequence: Synthetic oligonucleotide
  Target: ANGPTL3; (+) strand; PAM type: YTN; PAM sequence: TTA
taattctcaggacagaagaa

SEQ ID NO: 16762 - DNA, 20 bp, Artificial Sequence
  Description of Artificial Sequence: Synthetic oligonucleotide
  Target: ANGPTL3; (+) strand; PAM type: YTN; PAM sequence: TTC
tcaggacagaagaacaaaac

SEQ ID NO: 16763 - DNA, 20 bp, Artificial Sequence
  Description of Artificial Sequence: Synthetic oligonucleotide
  Target: ANGPTL3; (+) strand; PAM type: YTN; PAM sequence: CTC
aggacagaagaacaaaactg

SEQ ID NO: 16764 - DNA, 20 bp, Artificial Sequence
  Description of Artificial Sequence: Synthetic oligonucleotide
  Target: ANGPTL3; (+) strand; PAM type: YTN; PAM sequence: CTG
cccttctcagagtttgcatc

SEQ ID NO: 16765 - DNA, 20 bp, Artificial Sequence
  Description of Artificial Sequence: Synthetic oligonucleotide
  Target: ANGPTL3; (+) strand; PAM type: YTN; PAM sequence: CTT
ctcagagtttgcatctgttt

SEQ ID NO: 16766 - DNA, 20 bp, Artificial Sequence
  Description of Artificial Sequence: Synthetic oligonucleotide
  Target: ANGPTL3; (+) strand; PAM type: YTN; PAM sequence: TTC
tcagagtttgcatctgtttc

SEQ ID NO: 16767 - DNA, 20 bp, Artificial Sequence
  Description of Artificial Sequence: Synthetic oligonucleotide
  Target: ANGPTL3; (+) strand; PAM type: YTN; PAM sequence: CTC
agagtttgcatctgtttctg

SEQ ID NO: 16768 - DNA, 20 bp, Artificial Sequence
  Description of Artificial Sequence: Synthetic oligonucleotide
  Target: ANGPTL3; (+) strand; PAM type: YTN; PAM sequence: TTT
gcatctgtttctggaacttt

SEQ ID NO: 16769 - DNA, 20 bp, Artificial Sequence
  Description of Artificial Sequence: Synthetic oligonucleotide
  Target: ANGPTL3; (+) strand; PAM type: YTN; PAM sequence: TTG
catctgtttctggaacttta

SEQ ID NO: 16770 - DNA, 20 bp, Artificial Sequence
  Description of Artificial Sequence: Synthetic oligonucleotide
  Target: ANGPTL3; (+) strand; PAM type: YTN; PAM sequence: CTG
tttctggaactttactcctt

SEQ ID NO: 16771 - DNA, 20 bp, Artificial Sequence
  Description of Artificial Sequence: Synthetic oligonucleotide
  Target: ANGPTL3; (+) strand; PAM type: YTN; PAM sequence: TTT
ctggaactttactccttccc

SEQ ID NO: 16772 - DNA, 20 bp, Artificial Sequence
  Description of Artificial Sequence: Synthetic oligonucleotide
  Target: ANGPTL3; (+) strand; PAM type: YTN; PAM sequence: TTC
tggaactttactccttccct

SEQ ID NO: 16773 - DNA, 20 bp, Artificial Sequence
  Description of Artificial Sequence: Synthetic oligonucleotide
  Target: ANGPTL3; (+) strand; PAM type: YTN; PAM sequence: CTG
gaactttactccttcccttc

SEQ ID NO: 16774 - DNA, 20 bp, Artificial Sequence
  Description of Artificial Sequence: Synthetic oligonucleotide
  Target: ANGPTL3; (+) strand; PAM type: YTN; PAM sequence: CTT
tactccttcccttcacaatc

SEQ ID NO: 16775 - DNA, 20 bp, Artificial Sequence
  Description of Artificial Sequence: Synthetic oligonucleotide
  Target: ANGPTL3; (+) strand; PAM type: YTN; PAM sequence: TTT
actccttcccttcacaatct

SEQ ID NO: 16776 - DNA, 20 bp, Artificial Sequence
  Description of Artificial Sequence: Synthetic oligonucleotide
  Target: ANGPTL3; (+) strand; PAM type: YTN; PAM sequence: TTA
ctccttcccttcacaatcta

SEQ ID NO: 16777 - DNA, 20 bp, Artificial Sequence
  Description of Artificial Sequence: Synthetic oligonucleotide
  Target: ANGPTL3; (+) strand; PAM type: YTN; PAM sequence: CTC
cttcccttcacaatctaaga

SEQ ID NO: 16778 - DNA, 20 bp, Artificial Sequence
  Description of Artificial Sequence: Synthetic oligonucleotide
  Target: ANGPTL3; (+) strand; PAM type: YTN; PAM sequence: CTT
cccttcacaatctaagataa

SEQ ID NO: 16779 - DNA, 20 bp, Artificial Sequence
  Description of Artificial Sequence: Synthetic oligonucleotide
  Target: ANGPTL3; (+) strand; PAM type: YTN; PAM sequence: TTC
ccttcacaatctaagataac

SEQ ID NO: 16780 - DNA, 20 bp, Artificial Sequence
  Description of Artificial Sequence: Synthetic oligonucleotide
  Target: ANGPTL3; (+) strand; PAM type: YTN; PAM sequence: CTT
cacaatctaagataacactc

SEQ ID NO: 16781 - DNA, 20 bp, Artificial Sequence
  Description of Artificial Sequence: Synthetic oligonucleotide
  Target: ANGPTL3; (+) strand; PAM type: YTN; PAM sequence: TTC
acaatctaagataacactcc

SEQ ID NO: 16782 - DNA, 20 bp, Artificial Sequence
  Description of Artificial Sequence: Synthetic oligonucleotide
  Target: ANGPTL3; (+) strand; PAM type: YTN; PAM sequence: CTA
agataacactccatcacctt

SEQ ID NO: 16783 - DNA, 20 bp, Artificial Sequence
  Description of Artificial Sequence: Synthetic oligonucleotide
  Target: ANGPTL3; (+) strand; PAM type: YTN; PAM sequence: CTC
catcaccttcagatgcaagc

SEQ ID NO: 16784 - DNA, 20 bp, Artificial Sequence
  Description of Artificial Sequence: Synthetic oligonucleotide
  Target: ANGPTL3; (+) strand; PAM type: YTN; PAM sequence: CTT
cagatgcaagcccctaacta

SEQ ID NO: 16785 - DNA, 20 bp, Artificial Sequence
  Description of Artificial Sequence: Synthetic oligonucleotide
  Target: ANGPTL3; (+) strand; PAM type: YTN; PAM sequence: TTC
agatgcaagcccctaactaa

SEQ ID NO: 16786 - DNA, 20 bp, Artificial Sequence
  Description of Artificial Sequence: Synthetic oligonucleotide
  Target: ANGPTL3; (+) strand; PAM type: YTN; PAM sequence: CTA
actaaaaacttctgggtggc

SEQ ID NO: 16787 - DNA, 20 bp, Artificial Sequence
  Description of Artificial Sequence: Synthetic oligonucleotide
  Target: ANGPTL3; (+) strand; PAM type: YTN; PAM sequence: CTA
aaaacttctgggtggctatg

SEQ ID NO: 16788 - DNA, 20 bp, Artificial Sequence
  Description of Artificial Sequence: Synthetic oligonucleotide
  Target: ANGPTL3; (+) strand; PAM type: YTN; PAM sequence: CTT
ctgggtggctatgttaaaat

SEQ ID NO: 16789 - DNA, 20 bp, Artificial Sequence
  Description of Artificial Sequence: Synthetic oligonucleotide
  Target: ANGPTL3; (+) strand; PAM type: YTN; PAM sequence: TTC
tgggtggctatgttaaaatg

SEQ ID NO: 16790 - DNA, 20 bp, Artificial Sequence
  Description of Artificial Sequence: Synthetic oligonucleotide
  Target: ANGPTL3; (+) strand; PAM type: YTN; PAM sequence: CTG
ggtggctatgttaaaatgtt

SEQ ID NO: 16791 - DNA, 20 bp, Artificial Sequence
  Description of Artificial Sequence: Synthetic oligonucleotide
  Target: ANGPTL3; (+) strand; PAM type: YTN; PAM sequence: CTA
tgttaaaatgttaggaaata

SEQ ID NO: 16792 - DNA, 20 bp, Artificial Sequence
  Description of Artificial Sequence: Synthetic oligonucleotide
  Target: ANGPTL3; (+) strand; PAM type: YTN; PAM sequence: TTA
aaatgttaggaaatagagct

SEQ ID NO: 16793 - DNA, 20 bp, Artificial Sequence
  Description of Artificial Sequence: Synthetic oligonucleotide
  Target: ANGPTL3; (+) strand; PAM type: YTN; PAM sequence: TTA
ggaaatagagctcttgactc

SEQ ID NO: 16794 - DNA, 20 bp, Artificial Sequence
  Description of Artificial Sequence: Synthetic oligonucleotide
  Target: ANGPTL3; (+) strand; PAM type: YTN; PAM sequence: CTC
ttgactcagaattctttttt

SEQ ID NO: 16795 - DNA, 20 bp, Artificial Sequence
  Description of Artificial Sequence: Synthetic oligonucleotide
  Target: ANGPTL3; (+) strand; PAM type: YTN; PAM sequence: CTT
gactcagaattctttttttt

SEQ ID NO: 16796 - DNA, 20 bp, Artificial Sequence
  Description of Artificial Sequence: Synthetic oligonucleotide
  Target: ANGPTL3; (+) strand; PAM type: YTN; PAM sequence: TTG
actcagaattcttttttttt

SEQ ID NO: 16797 - DNA, 20 bp, Artificial Sequence
  Description of Artificial Sequence: Synthetic oligonucleotide
  Target: ANGPTL3; (+) strand; PAM type: YTN; PAM sequence: CTC
agaattcttttttttttcga

SEQ ID NO: 16798 - DNA, 20 bp, Artificial Sequence
  Description of Artificial Sequence: Synthetic oligonucleotide
  Target: ANGPTL3; (+) strand; PAM type: YTN; PAM sequence: TTC
ttttttttttcgagatggag

SEQ ID NO: 16799 - DNA, 20 bp, Artificial Sequence
  Description of Artificial Sequence: Synthetic oligonucleotide
  Target: ANGPTL3; (+) strand; PAM type: YTN; PAM sequence: CTT
ttttttttcgagatggagtc

SEQ ID NO: 16800 - DNA, 20 bp, Artificial Sequence
  Description of Artificial Sequence: Synthetic oligonucleotide
  Target: ANGPTL3; (+) strand; PAM type: YTN; PAM sequence: TTT
tttttttcgagatggagtct

SEQ ID NO: 16801 - DNA, 20 bp, Artificial Sequence
  Description of Artificial Sequence: Synthetic oligonucleotide
  Target: ANGPTL3; (+) strand; PAM type: YTN; PAM sequence: TTT
ttttttcgagatggagtctc

SEQ ID NO: 16802 - DNA, 20 bp, Artificial Sequence
  Description of Artificial Sequence: Synthetic oligonucleotide
  Target: ANGPTL3; (+) strand; PAM type: YTN; PAM sequence: TTT
tttttcgagatggagtctcg

SEQ ID NO: 16803 - DNA, 20 bp, Artificial Sequence
  Description of Artificial Sequence: Synthetic oligonucleotide
  Target: ANGPTL3; (+) strand; PAM type: YTN; PAM sequence: TTT
ttttcgagatggagtctcgc

SEQ ID NO: 16804 - DNA, 20 bp, Artificial Sequence
  Description of Artificial Sequence: Synthetic oligonucleotide
  Target: ANGPTL3; (+) strand; PAM type: YTN; PAM sequence: TTT
tttcgagatggagtctcgct

SEQ ID NO: 16805 - DNA, 20 bp, Artificial Sequence
  Description of Artificial Sequence: Synthetic oligonucleotide
  Target: ANGPTL3; (+) strand; PAM type: YTN; PAM sequence: TTT
ttcgagatggagtctcgctc

SEQ ID NO: 16806 - DNA, 20 bp, Artificial Sequence
  Description of Artificial Sequence: Synthetic oligonucleotide
  Target: ANGPTL3; (+) strand; PAM type: YTN; PAM sequence: TTT
tcgagatggagtctcgctct

SEQ ID NO: 16807 - DNA, 20 bp, Artificial Sequence
  Description of Artificial Sequence: Synthetic oligonucleotide
  Target: ANGPTL3; (+) strand; PAM type: YTN; PAM sequence: TTT
cgagatggagtctcgctctg

SEQ ID NO: 16808 - DNA, 20 bp, Artificial Sequence
  Description of Artificial Sequence: Synthetic oligonucleotide
  Target: ANGPTL3; (+) strand; PAM type: YTN; PAM sequence: TTC
gagatggagtctcgctctgt

SEQ ID NO: 16809 - DNA, 20 bp, Artificial Sequence
  Description of Artificial Sequence: Synthetic oligonucleotide
  Target: ANGPTL3; (+) strand; PAM type: YTN; PAM sequence: CTC
gctctgtcacccaggctgga

SEQ ID NO: 16810 - DNA, 20 bp, Artificial Sequence
  Description of Artificial Sequence: Synthetic oligonucleotide
  Target: ANGPTL3; (+) strand; PAM type: YTN; PAM sequence: CTC
tgtcacccaggctggagtgc

SEQ ID NO: 16811 - DNA, 20 bp, Artificial Sequence
  Description of Artificial Sequence: Synthetic oligonucleotide
  Target: ANGPTL3; (+) strand; PAM type: YTN; PAM sequence: CTG
tcacccaggctggagtgcag

SEQ ID NO: 16812 - DNA, 20 bp, Artificial Sequence
  Description of Artificial Sequence: Synthetic oligonucleotide
  Target: ANGPTL3; (+) strand; PAM type: YTN; PAM sequence: CTG
gagtgcagtggcactgcaca

SEQ ID NO: 16813 - DNA, 20 bp, Artificial Sequence
  Description of Artificial Sequence: Synthetic oligonucleotide
  Target: ANGPTL3; (+) strand; PAM type: YTN; PAM sequence: CTG
cacagtgagctgagtgatct

SEQ ID NO: 16814 - DNA, 20 bp, Artificial Sequence
  Description of Artificial Sequence: Synthetic oligonucleotide
  Target: ANGPTL3; (+) strand; PAM type: YTN; PAM sequence: CTG
agtgatctcagctctctgca

SEQ ID NO: 16815 - DNA, 20 bp, Artificial Sequence
  Description of Artificial Sequence: Synthetic oligonucleotide
  Target: ANGPTL3; (+) strand; PAM type: YTN; PAM sequence: CTC
agctctctgcaacctccgcc

SEQ ID NO: 16816 - DNA, 20 bp, Artificial Sequence
  Description of Artificial Sequence: Synthetic oligonucleotide
  Target: ANGPTL3; (+) strand; PAM type: YTN; PAM sequence: CTC
tctgcaacctccgcctcctg

SEQ ID NO: 16817 - DNA, 20 bp, Artificial Sequence
  Description of Artificial Sequence: Synthetic oligonucleotide
  Target: ANGPTL3; (+) strand; PAM type: YTN; PAM sequence: CTC
tgcaacctccgcctcctggg

SEQ ID NO: 16818 - DNA, 20 bp, Artificial Sequence
  Description of Artificial Sequence: Synthetic oligonucleotide
  Target: ANGPTL3; (+) strand; PAM type: YTN; PAM sequence: CTG
caacctccgcctcctgggtt

SEQ ID NO: 16819 - DNA, 20 bp, Artificial Sequence
  Description of Artificial Sequence: Synthetic oligonucleotide
  Target: ANGPTL3; (+) strand; PAM type: YTN; PAM sequence: CTC
cgcctcctgggttcaagtga

SEQ ID NO: 16820 - DNA, 20 bp, Artificial Sequence
  Description of Artificial Sequence: Synthetic oligonucleotide
  Target: ANGPTL3; (+) strand; PAM type: YTN; PAM sequence: CTC
ctgggttcaagtgattctcc

SEQ ID NO: 16821 - DNA, 20 bp, Artificial Sequence
  Description of Artificial Sequence: Synthetic oligonucleotide
  Target: ANGPTL3; (+) strand; PAM type: YTN; PAM sequence: CTG
ggttcaagtgattctcctgc

SEQ ID NO: 16822 - DNA, 20 bp, Artificial Sequence
  Description of Artificial Sequence: Synthetic oligonucleotide
  Target: ANGPTL3; (+) strand; PAM type: YTN; PAM sequence: TTC
aagtgattctcctgcctcag

SEQ ID NO: 16823 - DNA, 20 bp, Artificial Sequence
  Description of Artificial Sequence: Synthetic oligonucleotide
  Target: ANGPTL3; (+) strand; PAM type: YTN; PAM sequence: TTC
tcctgcctcagactcctgag

SEQ ID NO: 16824 - DNA, 20 bp, Artificial Sequence
  Description of Artificial Sequence: Synthetic oligonucleotide
  Target: ANGPTL3; (+) strand; PAM type: YTN; PAM sequence: CTC
ctgcctcagactcctgagta

SEQ ID NO: 16825 - DNA, 20 bp, Artificial Sequence
  Description of Artificial Sequence: Synthetic oligonucleotide
  Target: ANGPTL3; (+) strand; PAM type: YTN; PAM sequence: CTG
cctcagactcctgagtagct

SEQ ID NO: 16826 - DNA, 20 bp, Artificial Sequence
  Description of Artificial Sequence: Synthetic oligonucleotide
  Target: ANGPTL3; (+) strand; PAM type: YTN; PAM sequence: CTC
agactcctgagtagctagga

SEQ ID NO: 16827 - DNA, 20 bp, Artificial Sequence
  Description of Artificial Sequence: Synthetic oligonucleotide
  Target: ANGPTL3; (+) strand; PAM type: YTN; PAM sequence: CTC
ctgagtagctaggattacag

SEQ ID NO: 16828 - DNA, 20 bp, Artificial Sequence
  Description of Artificial Sequence: Synthetic oligonucleotide
  Target: ANGPTL3; (+) strand; PAM type: YTN; PAM sequence: CTG
agtagctaggattacaggta

SEQ ID NO: 16829 - DNA, 20 bp, Artificial Sequence
  Description of Artificial Sequence: Synthetic oligonucleotide
  Target: ANGPTL3; (+) strand; PAM type: YTN; PAM sequence: CTA
ggattacaggtatgtgccac

SEQ ID NO: 16830 - DNA, 20 bp, Artificial Sequence
  Description of Artificial Sequence: Synthetic oligonucleotide
  Target: ANGPTL3; (+) strand; PAM type: YTN; PAM sequence: TTA
caggtatgtgccaccatgcc

SEQ ID NO: 16831 - DNA, 20 bp, Artificial Sequence
  Description of Artificial Sequence: Synthetic oligonucleotide
  Target: ANGPTL3; (+) strand; PAM type: YTN; PAM sequence: CTG
gctaatttttgtatttttag

SEQ ID NO: 16832 - DNA, 20 bp, Artificial Sequence
  Description of Artificial Sequence: Synthetic oligonucleotide
  Target: ANGPTL3; (+) strand; PAM type: YTN; PAM sequence: CTA
atttttgtatttttagtaga

SEQ ID NO: 16833 - DNA, 20 bp, Artificial Sequence
  Description of Artificial Sequence: Synthetic oligonucleotide
  Target: ANGPTL3; (+) strand; PAM type: YTN; PAM sequence: TTT
ttgtatttttagtagagacg

SEQ ID NO: 16834 - DNA, 20 bp, Artificial Sequence
  Description of Artificial Sequence: Synthetic oligonucleotide
  Target: ANGPTL3; (+) strand; PAM type: YTN; PAM sequence: TTT
tgtatttttagtagagacgg

SEQ ID NO: 16835 - DNA, 20 bp, Artificial Sequence
  Description of Artificial Sequence: Synthetic oligonucleotide
  Target: ANGPTL3; (+) strand; PAM type: YTN; PAM sequence: TTT
gtatttttagtagagacgga

SEQ ID NO: 16836 - DNA, 20 bp, Artificial Sequence
  Description of Artificial Sequence: Synthetic oligonucleotide
  Target: ANGPTL3; (+) strand; PAM type: YTN; PAM sequence: TTG
tatttttagtagagacggag

SEQ ID NO: 16837 - DNA, 20 bp, Artificial Sequence
  Description of Artificial Sequence: Synthetic oligonucleotide
  Target: ANGPTL3; (+) strand; PAM type: YTN; PAM sequence: TTT
ttagtagagacggagtttca

SEQ ID NO: 16838 - DNA, 20 bp, Artificial Sequence
  Description of Artificial Sequence: Synthetic oligonucleotide
  Target: ANGPTL3; (+) strand; PAM type: YTN; PAM sequence: TTT
tagtagagacggagtttcat

SEQ ID NO: 16839 - DNA, 20 bp, Artificial Sequence
  Description of Artificial Sequence: Synthetic oligonucleotide
  Target: ANGPTL3; (+) strand; PAM type: YTN; PAM sequence: TTT
agtagagacggagtttcatc

SEQ ID NO: 16840 - DNA, 20 bp, Artificial Sequence
  Description of Artificial Sequence: Synthetic oligonucleotide
  Target: ANGPTL3; (+) strand; PAM type: YTN; PAM sequence: TTA
gtagagacggagtttcatca

SEQ ID NO: 16841 - DNA, 20 bp, Artificial Sequence
  Description of Artificial Sequence: Synthetic oligonucleotide
  Target: ANGPTL3; (+) strand; PAM type: YTN; PAM sequence: TTT
catcatgttggtcaggctgg

SEQ ID NO: 16842 - DNA, 20 bp, Artificial Sequence
  Description of Artificial Sequence: Synthetic oligonucleotide
  Target: ANGPTL3; (+) strand; PAM type: YTN; PAM sequence: TTC
atcatgttggtcaggctggt

SEQ ID NO: 16843 - DNA, 20 bp, Artificial Sequence
  Description of Artificial Sequence: Synthetic oligonucleotide
  Target: ANGPTL3; (+) strand; PAM type: YTN; PAM sequence: TTG
gtcaggctggtcccgaactc

SEQ ID NO: 16844 - DNA, 20 bp, Artificial Sequence
  Description of Artificial Sequence: Synthetic oligonucleotide
  Target: ANGPTL3; (+) strand; PAM type: YTN; PAM sequence: CTG
gtcccgaactcctgacctcg

SEQ ID NO: 16845 - DNA, 20 bp, Artificial Sequence
  Description of Artificial Sequence: Synthetic oligonucleotide
  Target: ANGPTL3; (+) strand; PAM type: YTN; PAM sequence: CTC
ctgacctcgtgatccgcctt

SEQ ID NO: 16846 - DNA, 20 bp, Artificial Sequence
  Description of Artificial Sequence: Synthetic oligonucleotide
  Target: ANGPTL3; (+) strand; PAM type: YTN; PAM sequence: CTG
acctcgtgatccgccttcct

SEQ ID NO: 16847 - DNA, 20 bp, Artificial Sequence
  Description of Artificial Sequence: Synthetic oligonucleotide
  Target: ANGPTL3; (+) strand; PAM type: YTN; PAM sequence: CTC
gtgatccgccttcctcggcc

SEQ ID NO: 16848 - DNA, 20 bp, Artificial Sequence
  Description of Artificial Sequence: Synthetic oligonucleotide
  Target: ANGPTL3; (+) strand; PAM type: YTN; PAM sequence: CTT
cctcggcctcccaaagtgct

SEQ ID NO: 16849 - DNA, 20 bp, Artificial Sequence
  Description of Artificial Sequence: Synthetic oligonucleotide
  Target: ANGPTL3; (+) strand; PAM type: YTN; PAM sequence: TTC
ctcggcctcccaaagtgcta

SEQ ID NO: 16850 - DNA, 20 bp, Artificial Sequence
  Description of Artificial Sequence: Synthetic oligonucleotide
  Target: ANGPTL3; (+) strand; PAM type: YTN; PAM sequence: CTC
ggcctcccaaagtgctaaga

SEQ ID NO: 16851 - DNA, 20 bp, Artificial Sequence
  Description of Artificial Sequence: Synthetic oligonucleotide
  Target: ANGPTL3; (+) strand; PAM type: YTN; PAM sequence: CTC
ccaaagtgctaagattacag

SEQ ID NO: 16852 - DNA, 20 bp, Artificial Sequence
  Description of Artificial Sequence: Synthetic oligonucleotide
  Target: ANGPTL3; (+) strand; PAM type: YTN; PAM sequence: CTA
agattacaggcgtgagcccc

SEQ ID NO: 16853 - DNA, 20 bp, Artificial Sequence
  Description of Artificial Sequence: Synthetic oligonucleotide
  Target: ANGPTL3; (+) strand; PAM type: YTN; PAM sequence: TTA
caggcgtgagcccccgcgcc

SEQ ID NO: 16854 - DNA, 20 bp, Artificial Sequence
  Description of Artificial Sequence: Synthetic oligonucleotide
  Target: ANGPTL3; (+) strand; PAM type: YTN; PAM sequence: CTC
agtttttatagttaaaataa

SEQ ID NO: 16855 - DNA, 20 bp, Artificial Sequence
  Description of Artificial Sequence: Synthetic oligonucleotide
  Target: ANGPTL3; (+) strand; PAM type: YTN; PAM sequence: TTT
ttatagttaaaataaactag

SEQ ID NO: 16856 - DNA, 20 bp, Artificial Sequence
  Description of Artificial Sequence: Synthetic oligonucleotide
  Target: ANGPTL3; (+) strand; PAM type: YTN; PAM sequence: TTT
tatagttaaaataaactagg

SEQ ID NO: 16857 - DNA, 20 bp, Artificial Sequence
  Description of Artificial Sequence: Synthetic oligonucleotide
  Target: ANGPTL3; (+) strand; PAM type: YTN; PAM sequence: TTT
atagttaaaataaactagga

SEQ ID NO: 16858 - DNA, 20 bp, Artificial Sequence
  Description of Artificial Sequence: Synthetic oligonucleotide
  Target: ANGPTL3; (+) strand; PAM type: YTN; PAM sequence: TTA
tagttaaaataaactaggac

SEQ ID NO: 16859 - DNA, 20 bp, Artificial Sequence
  Description of Artificial Sequence: Synthetic oligonucleotide
  Target: ANGPTL3; (+) strand; PAM type: YTN; PAM sequence: TTA
aaataaactaggaccaattc

SEQ ID NO: 16860 - DNA, 20 bp, Artificial Sequence
  Description of Artificial Sequence: Synthetic oligonucleotide
  Target: ANGPTL3; (+) strand; PAM type: YTN; PAM sequence: CTA
ggaccaattcgatagaataa

SEQ ID NO: 16861 - DNA, 20 bp, Artificial Sequence
  Description of Artificial Sequence: Synthetic oligonucleotide
  Target: ANGPTL3; (+) strand; PAM type: YTN; PAM sequence: TTC
gatagaataaaactcagagt

SEQ ID NO: 16862 - DNA, 20 bp, Artificial Sequence
  Description of Artificial Sequence: Synthetic oligonucleotide
  Target: ANGPTL3; (+) strand; PAM type: YTN; PAM sequence: CTC
agagtggtataacaaggaca

SEQ ID NO: 16863 - DNA, 20 bp, Artificial Sequence
  Description of Artificial Sequence: Synthetic oligonucleotide
  Target: ANGPTL3; (+) strand; PAM type: YTN; PAM sequence: CTT
gagacatctatgaactctaa

SEQ ID NO: 16864 - DNA, 20 bp, Artificial Sequence
  Description of Artificial Sequence: Synthetic oligonucleotide
  Target: ANGPTL3; (+) strand; PAM type: YTN; PAM sequence: TTG
agacatctatgaactctaaa

SEQ ID NO: 16865 - DNA, 20 bp, Artificial Sequence
  Description of Artificial Sequence: Synthetic oligonucleotide
  Target: ANGPTL3; (+) strand; PAM type: YTN; PAM sequence: CTA
tgaactctaaaaataaaaac

SEQ ID NO: 16866 - DNA, 20 bp, Artificial Sequence
  Description of Artificial Sequence: Synthetic oligonucleotide
  Target: ANGPTL3; (+) strand; PAM type: YTN; PAM sequence: CTC
taaaaataaaaacaaaaacc

SEQ ID NO: 16867 - DNA, 20 bp, Artificial Sequence
  Description of Artificial Sequence: Synthetic oligonucleotide
  Target: ANGPTL3; (+) strand; PAM type: YTN; PAM sequence: CTA
aaaataaaaacaaaaaccaa

SEQ ID NO: 16868 - DNA, 20 bp, Artificial Sequence
  Description of Artificial Sequence: Synthetic oligonucleotide
  Target: ANGPTL3; (+) strand; PAM type: YTN; PAM sequence: CTT
tctgaagcagagaaccatac

SEQ ID NO: 16869 - DNA, 20 bp, Artificial Sequence
  Description of Artificial Sequence: Synthetic oligonucleotide
  Target: ANGPTL3; (+) strand; PAM type: YTN; PAM sequence: TTT
ctgaagcagagaaccataca

SEQ ID NO: 16870 - DNA, 20 bp, Artificial Sequence
  Description of Artificial Sequence: Synthetic oligonucleotide
  Target: ANGPTL3; (+) strand; PAM type: YTN; PAM sequence: TTC
tgaagcagagaaccatacac

SEQ ID NO: 16871 - DNA, 20 bp, Artificial Sequence
  Description of Artificial Sequence: Synthetic oligonucleotide
  Target: ANGPTL3; (+) strand; PAM type: YTN; PAM sequence: CTG
aagcagagaaccatacactt

SEQ ID NO: 16872 - DNA, 20 bp, Artificial Sequence
  Description of Artificial Sequence: Synthetic oligonucleotide
  Target: ANGPTL3; (+) strand; PAM type: YTN; PAM sequence: CTT
gaatagaaaaaaaaatgctc

SEQ ID NO: 16873 - DNA, 20 bp, Artificial Sequence
  Description of Artificial Sequence: Synthetic oligonucleotide
  Target: ANGPTL3; (+) strand; PAM type: YTN; PAM sequence: TTG
aatagaaaaaaaaatgctcc

SEQ ID NO: 16874 - DNA, 20 bp, Artificial Sequence
  Description of Artificial Sequence: Synthetic oligonucleotide
  Target: ANGPTL3; (+) strand; PAM type: YTN; PAM sequence: CTC
ctgaattttcagtaacgttc

SEQ ID NO: 16875 - DNA, 20 bp, Artificial Sequence
  Description of Artificial Sequence: Synthetic oligonucleotide
  Target: ANGPTL3; (+) strand; PAM type: YTN; PAM sequence: CTG
aattttcagtaacgttcagc

SEQ ID NO: 16876 - DNA, 20 bp, Artificial Sequence
  Description of Artificial Sequence: Synthetic oligonucleotide
  Target: ANGPTL3; (+) strand; PAM type: YTN; PAM sequence: TTT
tcagtaacgttcagctgaaa

SEQ ID NO: 16877 - DNA, 20 bp, Artificial Sequence
  Description of Artificial Sequence: Synthetic oligonucleotide
  Target: ANGPTL3; (+) strand; PAM type: YTN; PAM sequence: TTT
cagtaacgttcagctgaaat

SEQ ID NO: 16878 - DNA, 20 bp, Artificial Sequence
  Description of Artificial Sequence: Synthetic oligonucleotide
  Target: ANGPTL3; (+) strand; PAM type: YTN; PAM sequence: TTC
agtaacgttcagctgaaatt

SEQ ID NO: 16879 - DNA, 20 bp, Artificial Sequence
  Description of Artificial Sequence: Synthetic oligonucleotide
  Target: ANGPTL3; (+) strand; PAM type: YTN; PAM sequence: TTC
agctgaaatttatacttcct

SEQ ID NO: 16880 - DNA, 20 bp, Artificial Sequence
  Description of Artificial Sequence: Synthetic oligonucleotide
  Target: ANGPTL3; (+) strand; PAM type: YTN; PAM sequence: CTG
aaatttatacttccttaaat

SEQ ID NO: 16881 - DNA, 20 bp, Artificial Sequence
  Description of Artificial Sequence: Synthetic oligonucleotide
  Target: ANGPTL3; (+) strand; PAM type: YTN; PAM sequence: TTT
atacttccttaaattatgaa

SEQ ID NO: 16882 - DNA, 20 bp, Artificial Sequence
  Description of Artificial Sequence: Synthetic oligonucleotide
  Target: ANGPTL3; (+) strand; PAM type: YTN; PAM sequence: TTA
tacttccttaaattatgaat

SEQ ID NO: 16883 - DNA, 20 bp, Artificial Sequence
  Description of Artificial Sequence: Synthetic oligonucleotide
  Target: ANGPTL3; (+) strand; PAM type: YTN; PAM sequence: CTT
ccttaaattatgaatgtagt

SEQ ID NO: 16884 - DNA, 20 bp, Artificial Sequence
  Description of Artificial Sequence: Synthetic oligonucleotide
  Target: ANGPTL3; (+) strand; PAM type: YTN; PAM sequence: TTC
cttaaattatgaatgtagta

SEQ ID NO: 16885 - DNA, 20 bp, Artificial Sequence
  Description of Artificial Sequence: Synthetic oligonucleotide
  Target: ANGPTL3; (+) strand; PAM type: YTN; PAM sequence: CTT
aaattatgaatgtagtaaac

SEQ ID NO: 16886 - DNA, 20 bp, Artificial Sequence
  Description of Artificial Sequence: Synthetic oligonucleotide
  Target: ANGPTL3; (+) strand; PAM type: YTN; PAM sequence: TTA
aattatgaatgtagtaaacc

SEQ ID NO: 16887 - DNA, 20 bp, Artificial Sequence
  Description of Artificial Sequence: Synthetic oligonucleotide
  Target: ANGPTL3; (+) strand; PAM type: YTN; PAM sequence: TTA
tgaatgtagtaaaccaacca

SEQ ID NO: 16888 - DNA, 20 bp, Artificial Sequence
  Description of Artificial Sequence: Synthetic oligonucleotide
  Target: ANGPTL3; (+) strand; PAM type: YTN; PAM sequence: TTA
ccagtatataagattttgtc

SEQ ID NO: 16889 - DNA, 20 bp, Artificial Sequence
  Description of Artificial Sequence: Synthetic oligonucleotide
  Target: ANGPTL3; (+) strand; PAM type: YTN; PAM sequence: TTT
tgtcattaatagaaacatac

SEQ ID NO: 16890 - DNA, 20 bp, Artificial Sequence
  Description of Artificial Sequence: Synthetic oligonucleotide
  Target: ANGPTL3; (+) strand; PAM type: YTN; PAM sequence: TTT
gtcattaatagaaacataca

SEQ ID NO: 16891 - DNA, 20 bp, Artificial Sequence
  Description of Artificial Sequence: Synthetic oligonucleotide
  Target: ANGPTL3; (+) strand; PAM type: YTN; PAM sequence: TTG
tcattaatagaaacatacat

SEQ ID NO: 16892 - DNA, 20 bp, Artificial Sequence
  Description of Artificial Sequence: Synthetic oligonucleotide
  Target: ANGPTL3; (+) strand; PAM type: YTN; PAM sequence: TTA
atagaaacatacatttacta

SEQ ID NO: 16893 - DNA, 20 bp, Artificial Sequence
  Description of Artificial Sequence: Synthetic oligonucleotide
  Target: ANGPTL3; (+) strand; PAM type: YTN; PAM sequence: TTT
actattattattattattat

SEQ ID NO: 16894 - DNA, 20 bp, Artificial Sequence
  Description of Artificial Sequence: Synthetic oligonucleotide
  Target: ANGPTL3; (+) strand; PAM type: YTN; PAM sequence: TTA
ctattattattattattatt

SEQ ID NO: 16895 - DNA, 20 bp, Artificial Sequence
  Description of Artificial Sequence: Synthetic oligonucleotide
  Target: ANGPTL3; (+) strand; PAM type: YTN; PAM sequence: CTA
ttattattattattattata

SEQ ID NO: 16896 - DNA, 20 bp, Artificial Sequence
  Description of Artificial Sequence: Synthetic oligonucleotide
  Target: ANGPTL3; (+) strand; PAM type: YTN; PAM sequence: TTA
ttattattattattatactt

SEQ ID NO: 16897 - DNA, 20 bp, Artificial Sequence
  Description of Artificial Sequence: Synthetic oligonucleotide
  Target: ANGPTL3; (+) strand; PAM type: YTN; PAM sequence: TTA
ttattattattatactttaa

SEQ ID NO: 16898 - DNA, 20 bp, Artificial Sequence
  Description of Artificial Sequence: Synthetic oligonucleotide
  Target: ANGPTL3; (+) strand; PAM type: YTN; PAM sequence: TTA
ttattattatactttaagtt

SEQ ID NO: 16899 - DNA, 20 bp, Artificial Sequence
  Description of Artificial Sequence: Synthetic oligonucleotide
  Target: ANGPTL3; (+) strand; PAM type: YTN; PAM sequence: TTA
ttattatactttaagttctg

SEQ ID NO: 16900 - DNA, 20 bp, Artificial Sequence
  Description of Artificial Sequence: Synthetic oligonucleotide
  Target: ANGPTL3; (+) strand; PAM type: YTN; PAM sequence: TTA
ttatactttaagttctggga

SEQ ID NO: 16901 - DNA, 20 bp, Artificial Sequence
  Description of Artificial Sequence: Synthetic oligonucleotide
  Target: ANGPTL3; (+) strand; PAM type: YTN; PAM sequence: TTA
tactttaagttctgggatac

SEQ ID NO: 16902 - DNA, 20 bp, Artificial Sequence
  Description of Artificial Sequence: Synthetic oligonucleotide
  Target: ANGPTL3; (+) strand; PAM type: YTN; PAM sequence: CTT
taagttctgggatacatgcg

SEQ ID NO: 16903 - DNA, 20 bp, Artificial Sequence
  Description of Artificial Sequence: Synthetic oligonucleotide
  Target: ANGPTL3; (+) strand; PAM type: YTN; PAM sequence: TTT
aagttctgggatacatgcgc

SEQ ID NO: 16904 - DNA, 20 bp, Artificial Sequence
  Description of Artificial Sequence: Synthetic oligonucleotide
  Target: ANGPTL3; (+) strand; PAM type: YTN; PAM sequence: TTA
agttctgggatacatgcgca

SEQ ID NO: 16905 - DNA, 20 bp, Artificial Sequence
  Description of Artificial Sequence: Synthetic oligonucleotide
  Target: ANGPTL3; (+) strand; PAM type: YTN; PAM sequence: TTC
tgggatacatgcgcagaacg

SEQ ID NO: 16906 - DNA, 20 bp, Artificial Sequence
  Description of Artificial Sequence: Synthetic oligonucleotide
  Target: ANGPTL3; (+) strand; PAM type: YTN; PAM sequence: CTG
ggatacatgcgcagaacgtg

SEQ ID NO: 16907 - DNA, 20 bp, Artificial Sequence
  Description of Artificial Sequence: Synthetic oligonucleotide
  Target: ANGPTL3; (+) strand; PAM type: YTN; PAM sequence: TTT
tgttacataggtatacacgt

SEQ ID NO: 16908 - DNA, 20 bp, Artificial Sequence
  Description of Artificial Sequence: Synthetic oligonucleotide
  Target: ANGPTL3; (+) strand; PAM type: YTN; PAM sequence: TTT
gttacataggtatacacgtg

SEQ ID NO: 16909 - DNA, 20 bp, Artificial Sequence
  Description of Artificial Sequence: Synthetic oligonucleotide
  Target: ANGPTL3; (+) strand; PAM type: YTN; PAM sequence: TTG
ttacataggtatacacgtgg

SEQ ID NO: 16910 - DNA, 20 bp, Artificial Sequence
  Description of Artificial Sequence: Synthetic oligonucleotide
  Target: ANGPTL3; (+) strand; PAM type: YTN; PAM sequence: TTA
cataggtatacacgtggtat

SEQ ID NO: 16911 - DNA, 20 bp, Artificial Sequence
  Description of Artificial Sequence: Synthetic oligonucleotide
  Target: ANGPTL3; (+) strand; PAM type: YTN; PAM sequence: TTT
gctgcacccatcaacccgtc

SEQ ID NO: 16912 - DNA, 20 bp, Artificial Sequence
  Description of Artificial Sequence: Synthetic oligonucleotide
  Target: ANGPTL3; (+) strand; PAM type: YTN; PAM sequence: TTG
ctgcacccatcaacccgtca

SEQ ID NO: 16913 - DNA, 20 bp, Artificial Sequence
  Description of Artificial Sequence: Synthetic oligonucleotide
  Target: ANGPTL3; (+) strand; PAM type: YTN; PAM sequence: CTG
cacccatcaacccgtcatct

SEQ ID NO: 16914 - DNA, 20 bp, Artificial Sequence
  Description of Artificial Sequence: Synthetic oligonucleotide
  Target: ANGPTL3; (+) strand; PAM type: YTN; PAM sequence: CTA
cattaggtatttctcctaat

SEQ ID NO: 16915 - DNA, 20 bp, Artificial Sequence
  Description of Artificial Sequence: Synthetic oligonucleotide
  Target: ANGPTL3; (+) strand; PAM type: YTN; PAM sequence: TTA
ggtatttctcctaatgctat

SEQ ID NO: 16916 - DNA, 20 bp, Artificial Sequence
  Description of Artificial Sequence: Synthetic oligonucleotide
  Target: ANGPTL3; (+) strand; PAM type: YTN; PAM sequence: TTT
ctcctaatgctatccctccc

SEQ ID NO: 16917 - DNA, 20 bp, Artificial Sequence
  Description of Artificial Sequence: Synthetic oligonucleotide
  Target: ANGPTL3; (+) strand; PAM type: YTN; PAM sequence: TTC
tcctaatgctatccctcccc

SEQ ID NO: 16918 - DNA, 20 bp, Artificial Sequence
  Description of Artificial Sequence: Synthetic oligonucleotide
  Target: ANGPTL3; (+) strand; PAM type: YTN; PAM sequence: CTC
ctaatgctatccctccccta

SEQ ID NO: 16919 - DNA, 20 bp, Artificial Sequence
  Description of Artificial Sequence: Synthetic oligonucleotide
  Target: ANGPTL3; (+) strand; PAM type: YTN; PAM sequence: CTA
atgctatccctcccctagcc

SEQ ID NO: 16920 - DNA, 20 bp, Artificial Sequence
  Description of Artificial Sequence: Synthetic oligonucleotide
  Target: ANGPTL3; (+) strand; PAM type: YTN; PAM sequence: CTA
tccctcccctagccccaccc

SEQ ID NO: 16921 - DNA, 20 bp, Artificial Sequence
  Description of Artificial Sequence: Synthetic oligonucleotide
  Target: ANGPTL3; (+) strand; PAM type: YTN; PAM sequence: CTC
ccctagccccaccccgacag

SEQ ID NO: 16922 - DNA, 20 bp, Artificial Sequence
  Description of Artificial Sequence: Synthetic oligonucleotide
  Target: ANGPTL3; (+) strand; PAM type: YTN; PAM sequence: CTA
gccccaccccgacaggtccc

SEQ ID NO: 16923 - DNA, 20 bp, Artificial Sequence
  Description of Artificial Sequence: Synthetic oligonucleotide
  Target: ANGPTL3; (+) strand; PAM type: YTN; PAM sequence: TTC
ctttccctgtgtccatgtgt

SEQ ID NO: 16924 - DNA, 20 bp, Artificial Sequence
  Description of Artificial Sequence: Synthetic oligonucleotide
  Target: ANGPTL3; (+) strand; PAM type: YTN; PAM sequence: CTT
tccctgtgtccatgtgttct

SEQ ID NO: 16925 - DNA, 20 bp, Artificial Sequence
  Description of Artificial Sequence: Synthetic oligonucleotide
  Target: ANGPTL3; (+) strand; PAM type: YTN; PAM sequence: TTT
ccctgtgtccatgtgttctc

SEQ ID NO: 16926 - DNA, 20 bp, Artificial Sequence
  Description of Artificial Sequence: Synthetic oligonucleotide
  Target: ANGPTL3; (+) strand; PAM type: YTN; PAM sequence: TTC
cctgtgtccatgtgttctca

SEQ ID NO: 16927 - DNA, 20 bp, Artificial Sequence
  Description of Artificial Sequence: Synthetic oligonucleotide
  Target: ANGPTL3; (+) strand; PAM type: YTN; PAM sequence: CTG
tgtccatgtgttctcattgt

SEQ ID NO: 16928 - DNA, 20 bp, Artificial Sequence
  Description of Artificial Sequence: Synthetic oligonucleotide
  Target: ANGPTL3; (+) strand; PAM type: YTN; PAM sequence: TTC
tcattgtttagctcccactt

SEQ ID NO: 16929 - DNA, 20 bp, Artificial Sequence
  Description of Artificial Sequence: Synthetic oligonucleotide
  Target: ANGPTL3; (+) strand; PAM type: YTN; PAM sequence: CTC
attgtttagctcccacttat

SEQ ID NO: 16930 - DNA, 20 bp, Artificial Sequence
  Description of Artificial Sequence: Synthetic oligonucleotide
  Target: ANGPTL3; (+) strand; PAM type: YTN; PAM sequence: TTG
tttagctcccacttatgagt

SEQ ID NO: 16931 - DNA, 20 bp, Artificial Sequence
  Description of Artificial Sequence: Synthetic oligonucleotide
  Target: ANGPTL3; (+) strand; PAM type: YTN; PAM sequence: TTT
agctcccacttatgagtgag

SEQ ID NO: 16932 - DNA, 20 bp, Artificial Sequence
  Description of Artificial Sequence: Synthetic oligonucleotide
  Target: ANGPTL3; (+) strand; PAM type: YTN; PAM sequence: TTA
gctcccacttatgagtgaga

SEQ ID NO: 16933 - DNA, 20 bp, Artificial Sequence
  Description of Artificial Sequence: Synthetic oligonucleotide
  Target: ANGPTL3; (+) strand; PAM type: YTN; PAM sequence: CTC
ccacttatgagtgagaacat

SEQ ID NO: 16934 - DNA, 20 bp, Artificial Sequence
  Description of Artificial Sequence: Synthetic oligonucleotide
  Target: ANGPTL3; (+) strand; PAM type: YTN; PAM sequence: CTT
atgagtgagaacatgtggtg

SEQ ID NO: 16935 - DNA, 20 bp, Artificial Sequence
  Description of Artificial Sequence: Synthetic oligonucleotide
  Target: ANGPTL3; (+) strand; PAM type: YTN; PAM sequence: TTA
tgagtgagaacatgtggtgt

SEQ ID NO: 16936 - DNA, 20 bp, Artificial Sequence
  Description of Artificial Sequence: Synthetic oligonucleotide
  Target: ANGPTL3; (+) strand; PAM type: YTN; PAM sequence: TTT
ggttttctgttcctgtgtta

SEQ ID NO: 16937 - DNA, 20 bp, Artificial Sequence
  Description of Artificial Sequence: Synthetic oligonucleotide
  Target: ANGPTL3; (+) strand; PAM type: YTN; PAM sequence: TTG
gttttctgttcctgtgttag

SEQ ID NO: 16938 - DNA, 20 bp, Artificial Sequence
  Description of Artificial Sequence: Synthetic oligonucleotide
  Target: ANGPTL3; (+) strand; PAM type: YTN; PAM sequence: TTT
tctgttcctgtgttagtttg

SEQ ID NO: 16939 - DNA, 20 bp, Artificial Sequence
  Description of Artificial Sequence: Synthetic oligonucleotide
  Target: ANGPTL3; (+) strand; PAM type: YTN; PAM sequence: TTT
ctgttcctgtgttagtttgc

SEQ ID NO: 16940 - DNA, 20 bp, Artificial Sequence
  Description of Artificial Sequence: Synthetic oligonucleotide
  Target: ANGPTL3; (+) strand; PAM type: YTN; PAM sequence: TTC
tgttcctgtgttagtttgct

SEQ ID NO: 16941 - DNA, 20 bp, Artificial Sequence
  Description of Artificial Sequence: Synthetic oligonucleotide
  Target: ANGPTL3; (+) strand; PAM type: YTN; PAM sequence: CTG
ttcctgtgttagtttgctga

SEQ ID NO: 16942 - DNA, 20 bp, Artificial Sequence
  Description of Artificial Sequence: Synthetic oligonucleotide
  Target: ANGPTL3; (+) strand; PAM type: YTN; PAM sequence: TTC
ctgtgttagtttgctgagaa

SEQ ID NO: 16943 - DNA, 20 bp, Artificial Sequence
  Description of Artificial Sequence: Synthetic oligonucleotide
  Target: ANGPTL3; (+) strand; PAM type: YTN; PAM sequence: CTG
tgttagtttgctgagaatga

SEQ ID NO: 16944 - DNA, 20 bp, Artificial Sequence
  Description of Artificial Sequence: Synthetic oligonucleotide
  Target: ANGPTL3; (+) strand; PAM type: YTN; PAM sequence: TTA
gtttgctgagaatgatggtt

SEQ ID NO: 16945 - DNA, 20 bp, Artificial Sequence
  Description of Artificial Sequence: Synthetic oligonucleotide
  Target: ANGPTL3; (+) strand; PAM type: YTN; PAM sequence: TTT
gctgagaatgatggtttcca

SEQ ID NO: 16946 - DNA, 20 bp, Artificial Sequence
  Description of Artificial Sequence: Synthetic oligonucleotide
  Target: ANGPTL3; (+) strand; PAM type: YTN; PAM sequence: TTG
ctgagaatgatggtttccag

SEQ ID NO: 16947 - DNA, 20 bp, Artificial Sequence
  Description of Artificial Sequence: Synthetic oligonucleotide
  Target: ANGPTL3; (+) strand; PAM type: YTN; PAM sequence: CTG
agaatgatggtttccagctt

SEQ ID NO: 16948 - DNA, 20 bp, Artificial Sequence
  Description of Artificial Sequence: Synthetic oligonucleotide
  Target: ANGPTL3; (+) strand; PAM type: YTN; PAM sequence: TTT
ccagcttcatccatgtccct

SEQ ID NO: 16949 - DNA, 20 bp, Artificial Sequence
  Description of Artificial Sequence: Synthetic oligonucleotide
  Target: ANGPTL3; (+) strand; PAM type: YTN; PAM sequence: TTC
cagcttcatccatgtcccta

SEQ ID NO: 16950 - DNA, 20 bp, Artificial Sequence
  Description of Artificial Sequence: Synthetic oligonucleotide
  Target: ANGPTL3; (+) strand; PAM type: YTN; PAM sequence: CTT
catccatgtccctacaaagg

SEQ ID NO: 16951 - DNA, 20 bp, Artificial Sequence
  Description of Artificial Sequence: Synthetic oligonucleotide
  Target: ANGPTL3; (+) strand; PAM type: YTN; PAM sequence: TTC
atccatgtccctacaaagga

SEQ ID NO: 16952 - DNA, 20 bp, Artificial Sequence
  Description of Artificial Sequence: Synthetic oligonucleotide
  Target: ANGPTL3; (+) strand; PAM type: YTN; PAM sequence: CTA
caaaggacatgaactcatcc

SEQ ID NO: 16953 - DNA, 20 bp, Artificial Sequence
  Description of Artificial Sequence: Synthetic oligonucleotide
  Target: ANGPTL3; (+) strand; PAM type: YTN; PAM sequence: CTC
atccttttttatggctgcat

SEQ ID NO: 16954 - DNA, 20 bp, Artificial Sequence
  Description of Artificial Sequence: Synthetic oligonucleotide
  Target: ANGPTL3; (+) strand; PAM type: YTN; PAM sequence: CTT
ttttatggctgcatagtatt

SEQ ID NO: 16955 - DNA, 20 bp, Artificial Sequence
  Description of Artificial Sequence: Synthetic oligonucleotide
  Target: ANGPTL3; (+) strand; PAM type: YTN; PAM sequence: TTT
tttatggctgcatagtattc

SEQ ID NO: 16956 - DNA, 20 bp, Artificial Sequence
  Description of Artificial Sequence: Synthetic oligonucleotide
  Target: ANGPTL3; (+) strand; PAM type: YTN; PAM sequence: TTT
ttatggctgcatagtattcc

SEQ ID NO: 16957 - DNA, 20 bp, Artificial Sequence
  Description of Artificial Sequence: Synthetic oligonucleotide
  Target: ANGPTL3; (+) strand; PAM type: YTN; PAM sequence: TTT
tatggctgcatagtattcca

SEQ ID NO: 16958 - DNA, 20 bp, Artificial Sequence
  Description of Artificial Sequence: Synthetic oligonucleotide
  Target: ANGPTL3; (+) strand; PAM type: YTN; PAM sequence: TTT
atggctgcatagtattccat

SEQ ID NO: 16959 - DNA, 20 bp, Artificial Sequence
  Description of Artificial Sequence: Synthetic oligonucleotide
  Target: ANGPTL3; (+) strand; PAM type: YTN; PAM sequence: TTA
tggctgcatagtattccatg

SEQ ID NO: 16960 - DNA, 20 bp, Artificial Sequence
  Description of Artificial Sequence: Synthetic oligonucleotide
  Target: ANGPTL3; (+) strand; PAM type: YTN; PAM sequence: CTG
catagtattccatggtgtat

SEQ ID NO: 16961 - DNA, 20 bp, Artificial Sequence
  Description of Artificial Sequence: Synthetic oligonucleotide
  Target: ANGPTL3; (+) strand; PAM type: YTN; PAM sequence: TTC
catggtgtatatgtgccaca

SEQ ID NO: 16962 - DNA, 20 bp, Artificial Sequence
  Description of Artificial Sequence: Synthetic oligonucleotide
  Target: ANGPTL3; (+) strand; PAM type: YTN; PAM sequence: TTT
tcttcatccagtctatcatt

SEQ ID NO: 16963 - DNA, 20 bp, Artificial Sequence
  Description of Artificial Sequence: Synthetic oligonucleotide
  Target: ANGPTL3; (+) strand; PAM type: YTN; PAM sequence: TTT
cttcatccagtctatcattg

SEQ ID NO: 16964 - DNA, 20 bp, Artificial Sequence
  Description of Artificial Sequence: Synthetic oligonucleotide
  Target: ANGPTL3; (+) strand; PAM type: YTN; PAM sequence: TTC
ttcatccagtctatcattga

SEQ ID NO: 16965 - DNA, 20 bp, Artificial Sequence
  Description of Artificial Sequence: Synthetic oligonucleotide
  Target: ANGPTL3; (+) strand; PAM type: YTN; PAM sequence: CTT
catccagtctatcattgatg

SEQ ID NO: 16966 - DNA, 20 bp, Artificial Sequence
  Description of Artificial Sequence: Synthetic oligonucleotide
  Target: ANGPTL3; (+) strand; PAM type: YTN; PAM sequence: TTC
atccagtctatcattgatgg

SEQ ID NO: 16967 - DNA, 20 bp, Artificial Sequence
  Description of Artificial Sequence: Synthetic oligonucleotide
  Target: ANGPTL3; (+) strand; PAM type: YTN; PAM sequence: CTA
tcattgatgggcatttgggt

SEQ ID NO: 16968 - DNA, 20 bp, Artificial Sequence
  Description of Artificial Sequence: Synthetic oligonucleotide
  Target: ANGPTL3; (+) strand; PAM type: YTN; PAM sequence: TTG
atgggcatttgggttggttc

SEQ ID NO: 16969 - DNA, 20 bp, Artificial Sequence
  Description of Artificial Sequence: Synthetic oligonucleotide
  Target: ANGPTL3; (+) strand; PAM type: YTN; PAM sequence: TTT
gggttggttccaagtctttg

SEQ ID NO: 16970 - DNA, 20 bp, Artificial Sequence
  Description of Artificial Sequence: Synthetic oligonucleotide
  Target: ANGPTL3; (+) strand; PAM type: YTN; PAM sequence: TTG
ggttggttccaagtctttgt

SEQ ID NO: 16971 - DNA, 20 bp, Artificial Sequence
  Description of Artificial Sequence: Synthetic oligonucleotide
  Target: ANGPTL3; (+) strand; PAM type: YTN; PAM sequence: TTG
gttccaagtctttgttattg

SEQ ID NO: 16972 - DNA, 20 bp, Artificial Sequence
  Description of Artificial Sequence: Synthetic oligonucleotide
  Target: ANGPTL3; (+) strand; PAM type: YTN; PAM sequence: TTC
caagtctttgttattgtgaa

SEQ ID NO: 16973 - DNA, 20 bp, Artificial Sequence
  Description of Artificial Sequence: Synthetic oligonucleotide
  Target: ANGPTL3; (+) strand; PAM type: YTN; PAM sequence: CTT
tgttattgtgaatagtgctg

SEQ ID NO: 16974 - DNA, 20 bp, Artificial Sequence
  Description of Artificial Sequence: Synthetic oligonucleotide
  Target: ANGPTL3; (+) strand; PAM type: YTN; PAM sequence: TTT
gttattgtgaatagtgctgc

SEQ ID NO: 16975 - DNA, 20 bp, Artificial Sequence
  Description of Artificial Sequence: Synthetic oligonucleotide
  Target: ANGPTL3; (+) strand; PAM type: YTN; PAM sequence: TTG
ttattgtgaatagtgctgca

SEQ ID NO: 16976 - DNA, 20 bp, Artificial Sequence
  Description of Artificial Sequence: Synthetic oligonucleotide
  Target: ANGPTL3; (+) strand; PAM type: YTN; PAM sequence: TTA
ttgtgaatagtgctgcaata

SEQ ID NO: 16977 - DNA, 20 bp, Artificial Sequence
  Description of Artificial Sequence: Synthetic oligonucleotide
  Target: ANGPTL3; (+) strand; PAM type: YTN; PAM sequence: TTG
tgaatagtgctgcaataaac

SEQ ID NO: 16978 - DNA, 20 bp, Artificial Sequence
  Description of Artificial Sequence: Synthetic oligonucleotide
  Target: ANGPTL3; (+) strand; PAM type: YTN; PAM sequence: CTG
caataaacatgtgtgcatgt

SEQ ID NO: 16979 - DNA, 20 bp, Artificial Sequence
  Description of Artificial Sequence: Synthetic oligonucleotide
  Target: ANGPTL3; (+) strand; PAM type: YTN; PAM sequence: CTT
tatagtagaatgatttataa

SEQ ID NO: 16980 - DNA, 20 bp, Artificial Sequence
  Description of Artificial Sequence: Synthetic oligonucleotide
  Target: ANGPTL3; (+) strand; PAM type: YTN; PAM sequence: TTT
atagtagaatgatttataat

SEQ ID NO: 16981 - DNA, 20 bp, Artificial Sequence
  Description of Artificial Sequence: Synthetic oligonucleotide
  Target: ANGPTL3; (+) strand; PAM type: YTN; PAM sequence: TTA
tagtagaatgatttataatc

SEQ ID NO: 16982 - DNA, 20 bp, Artificial Sequence
  Description of Artificial Sequence: Synthetic oligonucleotide
  Target: ANGPTL3; (+) strand; PAM type: YTN; PAM sequence: TTT
ataatcctttgaatatatac

SEQ ID NO: 16983 - DNA, 20 bp, Artificial Sequence
  Description of Artificial Sequence: Synthetic oligonucleotide
  Target: ANGPTL3; (+) strand; PAM type: YTN; PAM sequence: TTA
taatcctttgaatatatacc

SEQ ID NO: 16984 - DNA, 20 bp, Artificial Sequence
  Description of Artificial Sequence: Synthetic oligonucleotide
  Target: ANGPTL3; (+) strand; PAM type: YTN; PAM sequence: CTT
tgaatatatacccaataatg

SEQ ID NO: 16985 - DNA, 20 bp, Artificial Sequence
  Description of Artificial Sequence: Synthetic oligonucleotide
  Target: ANGPTL3; (+) strand; PAM type: YTN; PAM sequence: TTT
gaatatatacccaataatgg

SEQ ID NO: 16986 - DNA, 20 bp, Artificial Sequence
  Description of Artificial Sequence: Synthetic oligonucleotide
  Target: ANGPTL3; (+) strand; PAM type: YTN; PAM sequence: TTG
aatatatacccaataatggg

SEQ ID NO: 16987 - DNA, 20 bp, Artificial Sequence
  Description of Artificial Sequence: Synthetic oligonucleotide
  Target: ANGPTL3; (+) strand; PAM type: YTN; PAM sequence: TTA
ctgggtcaaatggtatttct

SEQ ID NO: 16988 - DNA, 20 bp, Artificial Sequence
  Description of Artificial Sequence: Synthetic oligonucleotide
  Target: ANGPTL3; (+) strand; PAM type: YTN; PAM sequence: CTG
ggtcaaatggtatttctagt

SEQ ID NO: 16989 - DNA, 20 bp, Artificial Sequence
  Description of Artificial Sequence: Synthetic oligonucleotide
  Target: ANGPTL3; (+) strand; PAM type: YTN; PAM sequence: TTT
ctagttctagttccttgagg

SEQ ID NO: 16990 - DNA, 20 bp, Artificial Sequence
  Description of Artificial Sequence: Synthetic oligonucleotide
  Target: ANGPTL3; (+) strand; PAM type: YTN; PAM sequence: TTC
tagttctagttccttgagga

SEQ ID NO: 16991 - DNA, 20 bp, Artificial Sequence
  Description of Artificial Sequence: Synthetic oligonucleotide
  Target: ANGPTL3; (+) strand; PAM type: YTN; PAM sequence: CTA
gttctagttccttgaggaat

SEQ ID NO: 16992 - DNA, 20 bp, Artificial Sequence
  Description of Artificial Sequence: Synthetic oligonucleotide
  Target: ANGPTL3; (+) strand; PAM type: YTN; PAM sequence: TTC
tagttccttgaggaatcgcc

SEQ ID NO: 16993 - DNA, 20 bp, Artificial Sequence
  Description of Artificial Sequence: Synthetic oligonucleotide
  Target: ANGPTL3; (+) strand; PAM type: YTN; PAM sequence: CTA
gttccttgaggaatcgccac

SEQ ID NO: 16994 - DNA, 20 bp, Artificial Sequence
  Description of Artificial Sequence: Synthetic oligonucleotide
  Target: ANGPTL3; (+) strand; PAM type: YTN; PAM sequence: TTC
cttgaggaatcgccacactg

SEQ ID NO: 16995 - DNA, 20 bp, Artificial Sequence
  Description of Artificial Sequence: Synthetic oligonucleotide
  Target: ANGPTL3; (+) strand; PAM type: YTN; PAM sequence: CTT
gaggaatcgccacactgtct

SEQ ID NO: 16996 - DNA, 20 bp, Artificial Sequence
  Description of Artificial Sequence: Synthetic oligonucleotide
  Target: ANGPTL3; (+) strand; PAM type: YTN; PAM sequence: TTG
aggaatcgccacactgtctt

SEQ ID NO: 16997 - DNA, 20 bp, Artificial Sequence
  Description of Artificial Sequence: Synthetic oligonucleotide
  Target: ANGPTL3; (+) strand; PAM type: YTN; PAM sequence: CTG
tcttccacaatggttgaact

SEQ ID NO: 16998 - DNA, 20 bp, Artificial Sequence
  Description of Artificial Sequence: Synthetic oligonucleotide
  Target: ANGPTL3; (+) strand; PAM type: YTN; PAM sequence: CTT
ccacaatggttgaactaatt

SEQ ID NO: 16999 - DNA, 20 bp, Artificial Sequence
  Description of Artificial Sequence: Synthetic oligonucleotide
  Target: ANGPTL3; (+) strand; PAM type: YTN; PAM sequence: TTC
cacaatggttgaactaattt

SEQ ID NO: 17000 - DNA, 20 bp, Artificial Sequence
  Description of Artificial Sequence: Synthetic oligonucleotide
  Target: ANGPTL3; (+) strand; PAM type: YTN; PAM sequence: TTG
aactaatttgaaacatacat

SEQ ID NO: 17001 - DNA, 20 bp, Artificial Sequence
  Description of Artificial Sequence: Synthetic oligonucleotide
  Target: ANGPTL3; (+) strand; PAM type: YTN; PAM sequence: CTA
atttgaaacatacatatttt

SEQ ID NO: 17002 - DNA, 20 bp, Artificial Sequence
  Description of Artificial Sequence: Synthetic oligonucleotide
  Target: ANGPTL3; (+) strand; PAM type: YTN; PAM sequence: TTT
gaaacatacatatttttata

SEQ ID NO: 17003 - DNA, 20 bp, Artificial Sequence
  Description of Artificial Sequence: Synthetic oligonucleotide
  Target: ANGPTL3; (+) strand; PAM type: YTN; PAM sequence: TTG
aaacatacatatttttatat

SEQ ID NO: 17004 - DNA, 20 bp, Artificial Sequence
  Description of Artificial Sequence: Synthetic oligonucleotide
  Target: ANGPTL3; (+) strand; PAM type: YTN; PAM sequence: TTT
ttatatcacaactattatag

SEQ ID NO: 17005 - DNA, 20 bp, Artificial Sequence
  Description of Artificial Sequence: Synthetic oligonucleotide
  Target: ANGPTL3; (+) strand; PAM type: YTN; PAM sequence: TTT
tatatcacaactattataga

SEQ ID NO: 17006 - DNA, 20 bp, Artificial Sequence
  Description of Artificial Sequence: Synthetic oligonucleotide
  Target: ANGPTL3; (+) strand; PAM type: YTN; PAM sequence: TTT
atatcacaactattatagac

SEQ ID NO: 17007 - DNA, 20 bp, Artificial Sequence
  Description of Artificial Sequence: Synthetic oligonucleotide
  Target: ANGPTL3; (+) strand; PAM type: YTN; PAM sequence: TTA
tatcacaactattatagaca

SEQ ID NO: 17008 - DNA, 20 bp, Artificial Sequence
  Description of Artificial Sequence: Synthetic oligonucleotide
  Target: ANGPTL3; (+) strand; PAM type: YTN; PAM sequence: CTA
ttatagacatctcaaaatat

SEQ ID NO: 17009 - DNA, 20 bp, Artificial Sequence
  Description of Artificial Sequence: Synthetic oligonucleotide
  Target: ANGPTL3; (+) strand; PAM type: YTN; PAM sequence: TTA
tagacatctcaaaatattgt

SEQ ID NO: 17010 - DNA, 20 bp, Artificial Sequence
  Description of Artificial Sequence: Synthetic oligonucleotide
  Target: ANGPTL3; (+) strand; PAM type: YTN; PAM sequence: CTC
aaaatattgttgatgcttat

SEQ ID NO: 17011 - DNA, 20 bp, Artificial Sequence
  Description of Artificial Sequence: Synthetic oligonucleotide
  Target: ANGPTL3; (+) strand; PAM type: YTN; PAM sequence: TTG
ttgatgcttattactattta

SEQ ID NO: 17012 - DNA, 20 bp, Artificial Sequence
  Description of Artificial Sequence: Synthetic oligonucleotide
  Target: ANGPTL3; (+) strand; PAM type: YTN; PAM sequence: TTG
atgcttattactatttagaa

SEQ ID NO: 17013 - DNA, 20 bp, Artificial Sequence
  Description of Artificial Sequence: Synthetic oligonucleotide
  Target: ANGPTL3; (+) strand; PAM type: YTN; PAM sequence: CTT
attactatttagaaaataca

SEQ ID NO: 17014 - DNA, 20 bp, Artificial Sequence
  Description of Artificial Sequence: Synthetic oligonucleotide
  Target: ANGPTL3; (+) strand; PAM type: YTN; PAM sequence: TTA
ttactatttagaaaatacaa

SEQ ID NO: 17015 - DNA, 20 bp, Artificial Sequence
  Description of Artificial Sequence: Synthetic oligonucleotide
  Target: ANGPTL3; (+) strand; PAM type: YTN; PAM sequence: TTA
ctatttagaaaatacaatag

SEQ ID NO: 17016 - DNA, 20 bp, Artificial Sequence
  Description of Artificial Sequence: Synthetic oligonucleotide
  Target: ANGPTL3; (+) strand; PAM type: YTN; PAM sequence: CTA
tttagaaaatacaatagttt

SEQ ID NO: 17017 - DNA, 20 bp, Artificial Sequence
  Description of Artificial Sequence: Synthetic oligonucleotide
  Target: ANGPTL3; (+) strand; PAM type: YTN; PAM sequence: TTT
agaaaatacaatagtttttt

SEQ ID NO: 17018 - DNA, 20 bp, Artificial Sequence
  Description of Artificial Sequence: Synthetic oligonucleotide
  Target: ANGPTL3; (+) strand; PAM type: YTN; PAM sequence: TTA
gaaaatacaatagtttttta

SEQ ID NO: 17019-17048 - skipped (30 entries)

SEQ ID NO: 17049 - DNA, 23 bp, Artificial Sequence
  Description of Artificial Sequence: Synthetic oligonucleotide
  modified_base (1)..(21): a, c, t, g, unknown or other
nnnnnnnnnnnnnnnnnnnnnrg

SEQ ID NO: 17050 - RNA, 100 nt, Artificial Sequence
  Artificial Polynucleotide <220
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 17051 - RNA, 96 nt, Artificial Sequence
  Artificial Polynucleotide
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 17052 - RNA, 114 nt, Artificial Sequence
  Artificial Polynucleotide
  misc_feature (1)..(30): n is a, c, g, or u
  misc_feature (18)..(30): nucleotides from position 18 to 30 may be absent
  misc_feature (108)..(114): uridines from position 108 to 114 may be absent
nnnnnnnnnnnnnnnnnnnnnnnnnnnnnnguuuuagagcuagaaauagcaaguuaaaauaaggcuaguccguuaucaacuugaaaaaguggcaccgagucggugcuuuuuuuu

SEQ ID NO: 17053 - RNA, 4 nt, Artificial Sequence
  Artificial Polynucleotide
  misc_feature (4)..(4): n is a, c, g, or u
rrrn

SEQ ID NO: 17054 - DNA, 20 bp, Homo sapiens
gactttgtccataagacgaa

SEQ ID NO: 17055 - DNA, 20 bp, Homo sapiens
gccaatggcctccttcagtt

SEQ ID NO: 17056 - DNA, 20 bp, Homo sapiens
ggcctccttcagttgggaca

SEQ ID NO: 17057 - DNA, 20 bp, Homo sapiens
caaagaccttctccagaccg

SEQ ID NO: 17058 - RNA, 100 nt, Artificial Sequence; identical to SEQ ID NO: 17050
  Artificial Polynucleotide
  modified_base (1)..(3): is a 2'-O-methyl phosphorothioate nucleotide
  misc_feature (1)..(20): n is a, c, g, or u
  modified_base (29)..(32): nucleotides have a 2'-O-methyl modification
  modified_base (37)..(40): nucleotides have a 2'-O-methyl modification
  modified_base (68)..(72): nucleotides have a 2'-O-methyl modification
  modified_base (77)..(96): nucleotides have a 2'-O-methyl modification
  modified_base (97)..(99): is a 2'-O-methyl phosphorothioate uracil

SEQ ID NO: 17059 - RNA, 100 nt, Artificial Sequence
  Artificial Polypeptide
  modified_base (1)..(1): is a 2'-O-methyl phosphorothioate guanine
  modified_base (2)..(2): is a 2'-O-methyl phosphorothioate adenosine
  modified_base (3)..(3): is a 2'-O-methyl phosphorothioate cytosine
  modified_base (29)..(32): nucleotides have a 2'-O-methyl modification
  modified_base (37)..(40): nucleotides have a 2'-O-methyl modification
  modified_base (68)..(72): nucleotides have a 2'-O-methyl modification
  modified_base (77)..(96): nucleotides have a 2'-O-methyl modification
  modified_base (97)..(99): is a 2'-O-methyl phosphorothioate uracil
gacuuuguccauaagacgaaguuuuagagcuagaaauagcaaguuaaaauaaggcuaguccguuaucaacuugaaaaaguggcaccgagucggugcuuuu

SEQ ID NO: 17060 - RNA, 100 nt, Artificial Sequence
  Artificial Polypeptide
  modified_base (1)..(1): is a 2'-O-methyl phosphorothioate guanine
  modified_base (2)..(3): is a 2'-O-methyl phosphorothioate cytosine
  modified_base (29)..(32): nucleotides have a 2'-O-methyl modification
  modified_base (37)..(40): nucleotides have a 2'-O-methyl modification
  modified_base (68)..(72): nucleotides have a 2'-O-methyl modification
  modified_base (77)..(96): nucleotides have a 2'-O-methyl modification
  modified_base (97)..(99): is a 2'-O-methyl phosphorothioate uracil
gccaauggccuccuucaguuguuuuagagcuagaaauagcaaguuaaaauaaggcuaguccguuaucaacuugaaaaaguggcaccgagucggugcuuuu

SEQ ID NO: 17061 - RNA, 100 nt, Artificial Sequence
  Artificial Polynucleotide
  modified_base (1)..(2): is a 2'-O-methyl phosphorothioate guanine
  modified_base (3)..(3): is a 2'-O-methyl phosphorothioate cytosine
  modified_base (29)..(32): nucleotides have a 2'-O-methyl modification
  modified_base (37)..(40): nucleotides have a 2'-O-methyl modification
  modified_base (68)..(72): nucleotides have a 2'-O-methyl modification
  modified_base (77)..(96): nucleotides have a 2'-O-methyl modification
  modified_base (97)..(99): is a 2'-O-methyl phosphorothioate uracil
ggccuccuucaguugggacaguuuuagagcuagaaauagcaaguuaaaauaaggcuaguccguuaucaacuugaaaaaguggcaccgagucggugcuuuu

SEQ ID NO: 17062 - RNA, 100 nt, Artificial Sequence
  Artificial Polynucleotide
  modified_base (1)..(1): is a 2'-O-methyl phosphorothioate cytosine
  modified_base (2)..(3): is a 2'-O-methyl phosphorothioate adenosine
  modified_base (29)..(32): nucleotides have a 2'-O-methyl modification
  modified_base (37)..(40): nucleotides have a 2'-O-methyl modification
  modified_base (68)..(72): nucleotides have a 2'-O-methyl modification
  modified_base (77)..(96): nucleotides have a 2'-O-methyl modification
  modified_base (97)..(99): is a 2'-O-methyl phosphorothioate uracil
caaagaccuucuccagaccgguuuuagagcuagaaauagcaaguuaaaauaaggcuaguccguuaucaacuugaaaaaguggcaccgagucggugcuuuu

SEQ ID NO: 17063 - RNA, 100 nt, Artificial Sequence; identical to SEQ ID NO: 17059
  Artificial Polynucleotide

SEQ ID NO: 17064 - RNA, 100 nt, Artificial Sequence; identical to SEQ ID NO: 17060
  Artificial Polynucleotide

SEQ ID NO: 17065 - RNA, 100 nt, Artificial Sequence; identical to SEQ ID NO: 17061
  Artificial Polynucleotide

SEQ ID NO: 17066 - RNA, 100 nt, Artificial Sequence; identical to SEQ ID NO: 17062
  Artificial Polynucleotide

SEQ ID NO: 17067 - DNA, 4 bp, Artificial Sequence
  Artificial Polynucleotide
  misc_feature (4)..(4): n is a, c, g, or t
aagn

SEQ ID NO: 17068 - RNA, 20 nt, Artificial Sequence
  Artificial Polynucleotide
gacuuuguccauaagacgaa

SEQ ID NO: 17069 - RNA, 20 nt, Artificial Sequence
  Artificial Polynucleotide
gccaauggccuccuucaguu

SEQ ID NO: 17070 - RNA, 20 nt, Artificial Sequence
  Artificial Polynucleotide
ggccuccuucaguugggaca

SEQ ID NO: 17071 - RNA, 20 nt, Artificial Sequence
  Artificial Polynucleotide
caaagaccuucuccagaccg
